US008349567B2

(12) United States Patent
Gebauer et al.

(10) Patent No.: US 8,349,567 B2
(45) Date of Patent: Jan. 8, 2013

(54) CATHEPSIN C-BASED SCREENING METHODS FOR IDENTIFYING MODULATORS OF PAIN

(75) Inventors: Mathias Gebauer, Frankfurt am Main (DE); Martin Michaelis, Frankfurt am Main (DE); Danping Ding-Pfennigdorff, Frankfurt am Main (DE); Anke Schulte, Frankfurt am Main (DE); Christiane Metz-Weidmann, Frankfurt am Main (DE)

(73) Assignee: SANOFI, Paris (FR)

( * ) Notice: Subject to any disclaimer, the term of this patent is extended or adjusted under 35 U.S.C. 154(b) by 0 days.

(21) Appl. No.: 12/934,178

(22) PCT Filed: Mar. 21, 2009

(86) PCT No.: PCT/EP2009/002091
§ 371 (c)(1),
(2), (4) Date: Dec. 10, 2010

(87) PCT Pub. No.: WO2009/118137
PCT Pub. Date: Oct. 1, 2009

(65) Prior Publication Data
US 2011/0091888 A1 Apr. 21, 2011

(30) Foreign Application Priority Data
Mar. 26, 2008 (EP) ..................... 08290285

(51) Int. Cl.
*C12Q 1/68* (2006.01)
*C12Q 1/66* (2006.01)
(52) U.S. Cl. ............ 435/6.13; 435/6.1; 435/6.18; 435/8
(58) Field of Classification Search ........................ None
See application file for complete search history.

(56) References Cited

U.S. PATENT DOCUMENTS

| 4,816,397 | A | 3/1989 | Boss et al. |
| 4,816,567 | A | 3/1989 | Cabilly et al. |

FOREIGN PATENT DOCUMENTS

| EP | 0 368 684 | | 5/1990 |
| EP | 0889723 | | 3/1997 |
| EP | 0852493 | | 4/1997 |
| EP | 0916336 | A1 | 5/1999 |
| EP | 0944398 | B1 | 4/2004 |
| WO | WO 88/01649 | | 3/1988 |
| WO | WO 93/06213 | | 4/1993 |
| WO | WO 98/24884 | | 6/1998 |
| WO | WO 03/020287 | A2 | 3/2003 |
| WO | WO 2004/077053 | A1 | 9/2004 |
| WO | WO 2005/113789 | A2 | 5/2005 |
| WO | WO 2005/106012 | A2 | 11/2005 |
| WO | WO 2006/122237 | A2 | 11/2006 |
| WO | WO 2007/045476 | A2 | 4/2007 |

OTHER PUBLICATIONS

Wells, J.A. (1990). Additivity of mutational effects in proteins. Biochemistry. 29(37):8509-8517.*

Ngo et al. (1994). Computational complexity, protein structure prediction, and the Levinthal paradox. In Merz and Le Grand (Eds.) The Protein Folding Problem and Tertiary Structure Prediction. Birkhauser:Boston, pp. 491-495.*
International Search Report WO2009/118137A1 dated Oct. 1, 2009.
Adkison et al., Dipeptidyl peptidase I activates neutrophil-derived serine proteases and regulates the development of acute experimental arthritis. J. of Clinical Investigations. 2002. vol. 109, pp. 363-371.
Baugh et al., Quantitative analysis of mRNA amplification by in vitro transcription, Nucleic Acids Research, vol. 29, No. 5, pp. 5, e29, pp. 1-9, 2001.
Cigic et al., The Residual Pro-Part of Cathepsin C Fulfills the Criteria Required for an Intramolecular Chaperone in Folding and Stabilizing the Human Proenzyme, Biochemistry, vol. 39, 2000, pp. 12383-12390.
De Haar et al., Loss-of-funtion Mutations in Cathepsin C in Two Families With Papillon-Lefevre Syndrome are Associated With Deficiency of Serine Proteinases in PMNs, Human Mutation, Mutationin Brief (Online, 2004.
Deleo et al., Transgenic expression of TNF by astrocytes increases mechanical allodynia in a mouse neuropathy model, Neuroreport, vol. 11, No. 3, Feb. 28, 2000, pp. 599-602.
Diamond et al, Monoclonal Antibodies, New England Journal of Medicine, vol. 304, No. 22, May 28, 1981, pp. 1344-1349.
Henningsson et l., Mast Cell cathepsins C and S control levels of carboxypeptidase A and the chymase, mouse mast cell protease 5, Biological Chemistry, 2003, vol. 384, pp. 1527-1531.
Heusel et al., Cytotoxic Lymphocytes Require Granzyme B for the Rapid Induction of DNA Fragmentation and Apoptosis in Allogeneic Target Cells, Cell, vol. 76, Mar. 25, 1994, pp. 977-987.
Julius et al., Molecular mechanisms of nociception, Nature, vol. 413, 2001, pp. 203-309.
Mansour et el., Disruption of the proto-oncogene int-2 in mouse embryo-derived stem cells: a general strategy for targeting mutations to non-selectable genes, Nature, vol. 336, Nov. 24, 1998, pp. 348-352.
McGuire et al., Generation of Active Myeloid and Lymphoid Granule Serino Proteases Requires Processing by the Granule Thiol Protease Dipeptidyl Peptidase I. J. of Biol. Chem, vol. 268, Feb. 5, 1993, pp. 2458-2467.
Paris et al., Molecular cloning and sequence analysis of human preprocathepsin C. FEBS Letters, 1995, vol. 369, pp. 326-330.
Pham et al., Dipeptidyl peptidase I is required for the processing and activation of granzymes A and B in vivo, PNAS, vol. 96, Jul. 1998, pp. 8627-8632.
Pham et al., Molecular Cloning, Chromosomal Localization, and Expression of Murine Dipeptidyl Peptidase I, J of Biol. Chem., vol. 272. No. 16, Apr. 18, 1997, pp. 10696-10703.
Pham et al., Papillon-Lefe'vre Syndrome: Correlating the Molecular, Cellular, and Clinical Consequences of Cathepsin C/Dipeptidyl Peptidase I Deficiency in Humans1, J. of Immunology. vol. 173, 2004, pp. 7277-7281.

(Continued)

*Primary Examiner* — Christine J Saoud
*Assistant Examiner* — Jon M Lockard
(74) *Attorney, Agent, or Firm* — Nicole L. M. Parsons

(57) ABSTRACT

Present invention concerns the use of Cathepsin C. Other aspects of the invention concern methods for screening pharmaceuticals, for diagnosing pain susceptibility and for the treatment of pain.

7 Claims, 7 Drawing Sheets

OTHER PUBLICATIONS

Figure 1:
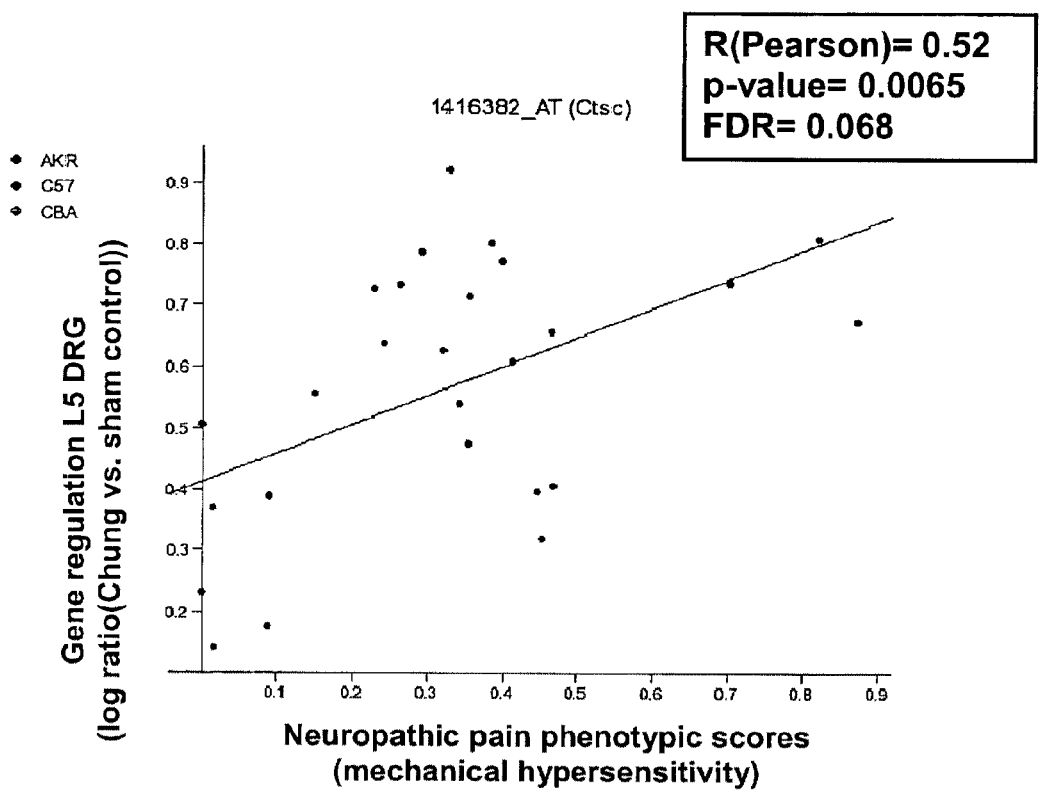

Rao et al., Human Dipeptidyl-peptidase I, J. of Biol. Chem. vol. 272, Apr. 11, 1997, pp. 10260-10265.

Scholz, Joachim, et al., Can we conquer pain?, Nature Neuroscience. (2002), vol. 5, pp. 1062-1067.

Sheth et al., Inhibition of dipeptidyl peptidase I in the human mast cell line HMC-1: blocked activation of tryptase, but not of the predominant chymotryptic activity, Biochemical Pharmacology, vol. 66, 2003, pp. 2251-2262.

Soriano et al., Targeted Disruption of the c-src Proto-Oncogene Leads to Osetopetrosis in Mice, Cell, vol. 54, Feb. 22, 1991, pp. 693-702.

Storey, J., A direct approach to false discovery rates, J.R. Statist. Soc. B. vol. 64, Part 3. 2002, pp. 479-498.

Szabo et al., Role of Transient Receptor Potential Vanilloid 1 Receptors in Adjuvant-Induced Chronic Arthritis: In Vivo Study Using Gene-Deficient Mice, J. of Pharmcol and Exp. Therapeutics, vol. 314, No. 1, 2005, pp. 111-119.

Toomes et al., Loss-of-function mutations in the cathepsin C gene result in periodontal disease and palmoplantar keratosis, Nature Genetics, vol. 23, 1999, pp. 421-424.

Turk et al., Lysosomal cysteine proteases: more than scavengers, Biochimica et Biophysica Acta, 2000, vol. 1477, pp. 98-111.

Winter et al., Man-made antibodies, Nature, vol. 349, Jan. 24, 1991, pp. 293-299.

Wolters et al., Dipeptidyl Peptidase I is Essential for Activation of Mast Cell Chymases, but Not Tryptases, In Mice, J. of Biol. Chem., vol. 276, May 25, 2001, pp. 18551-18556.

Wolters et al., Regulated Expression, Processing, and Secretion of Dog Mast Cell Dipeptidyl Peptidase I, J. of Biol. Chem., vol. 273, No. 25, Jun. 19, 1998, pp. 15514-15520.

Wood, John N., Pathobiology of Visceral Pain: Molecular Mechanisms and Therapeutic implications II. Genetic approaches to pain therapy, Am. J. Physiol Gastrointest Liver Physiol, (2000), vol. 278, pp. G507-G512.

Woolf, Clifford J. et al., Neuronal Plasticity: Increasing the Gain in Pain, Science, (2000), vol. 288. pp. 1765-1768.

Woolf, Clifford J. et al., Neuropathic pain: aetiology, symptoms, mechanisms, and management, The Lancet, (1999), vol. 353, pp. 1959-1964.

\* cited by examiner

Figure 2      Cathepsin C: Intensity data, L5 DRG, 3d p.o.
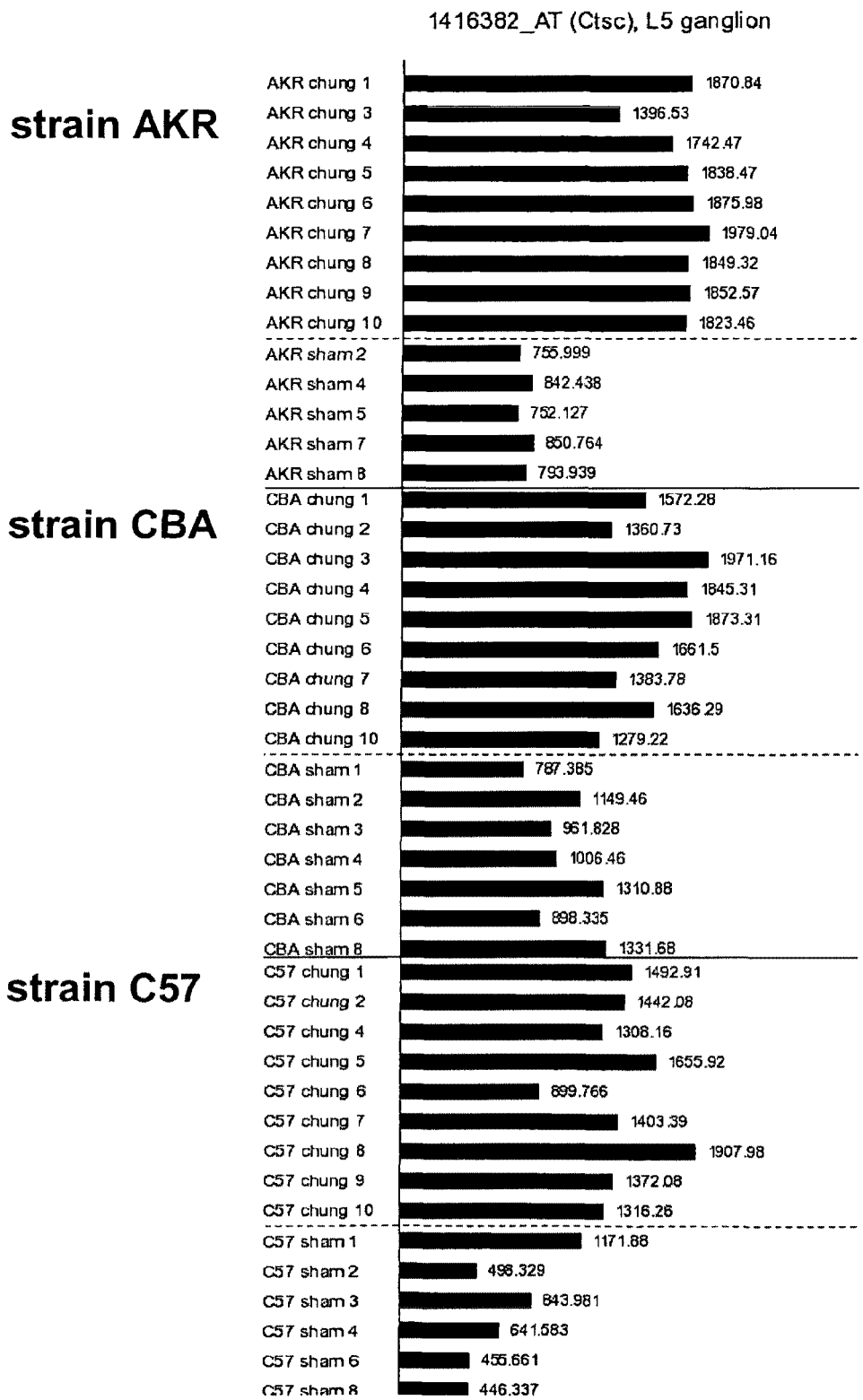

Figure 3: fragment of mouse Cathepsin cDNA

```
gctgttttgcttgtgggctatggaagagatccagttactgggatagaatactggattata
aagaacagctggggctctaactggggggagagtggctacttccgtatccgcagaggaact
gatgaatgtgcaattgagagtatagccgtggcggccnataccgattcctaaattatagga
catagctcccagtgttacatacgggtctttatcactcacagagtgatttagtcacatgct
gaagactttttcagagcaatatcagaagcttaccactaagcatctttaaagaattttgtc
tttgaacttaaaaccatccttgattttttcttttaatatcttccccatcaactactgaa
```

SEQ ID NO: 7

Figure 4: Cathepsin C human mRNA sequence

```
   1 cgtagctatt tcaaggcgcg cgcctcgtgg tggactcacc gctagcccgc agcgctcggc
  61 ttcctggtaa ttcttcacct cttttctcag ctccctgcag catgggtgct gggccctcct
 121 tgctgctcgc cgccctcctg ctgcttctct ccggcgacgg cgccgtgcgc tgcgacacac
 181 ctgccaactg cacctatctt gacctgctgg gcacctgggt cttccaggtg ggctccagcg
 241 gttcccagcg cgatgtcaac tgctcggtta tgggaccaca agaaaaaaaa gtagtggtgt
 301 accttcagaa gctggataca gcatatgatg accttggcaa ttctggccat ttcaccatca
 361 tttacaacca aggctttgag attgtgttga atgactacaa gtggtttgcc tttttttaagt
 421 ataaagaaga gggcagcaag gtgaccactt actgcaacga caatgact gggtgggtgc
 481 atgatgtgtt gggccggaac tgggcttgtt tcaccggaaa gaaggtggga actgcctctg
 541 agaatgtgta tgtcaacata gcacacctta agaattctca ggaaaagtat tctaataggc
 601 tctacaagta tgatcacaac tttgtgaaag ctatcaatgc cattcagaag tcttggactg
 661 caactacata catggaatat gagactctta ccctgggaga tatgattagg agaagtggtg
 721 gccacagtcg aaaaatccca aggcccaaac ctgcaccact gactgctgaa atacagcaaa
 781 agattttgca tttgccaaca tcttgggact ggagaaatgt tcatggtatc aattttgtca
 841 gtcctgttcg aaaccaagca tcctgtggca gctgctactc atttgcttct atgggtatgc
 901 tagaagcgag aatccgtata ctaaccaaca ttctcagac cccaatccta agccctcagg
 961 aggttgtgtc ttgtagccag tatgctcaag gctgtgaagg cggcttccca taccttattg
1021 caggaaagta cgcccaagat tttgggctgg tggaagaagc ttgcttcccc tacacaggca
1081 ctgattctcc atgcaaaatg aaggaagact gctttcgtta ttactcctct gagtaccact
1141 atgtaggagg tttctatgga ggctgcaatg aagccctgat gaagcttgag ttggtccatc
1201 atgggcccat ggcagttgct tttgaagtat atgatgactt cctccactac aaaaagggga
1261 tctaccacca cactggtcta agagaccctt caacccctt tgagctgact aatcatgctg
1321 ttctgcttgt gggctatggc actgactcag cctctgggat ggattactgg attgttaaaa
1381 acagctgggg caccggctgg ggtgagaatg gctacttccg gatccgcaga ggaactgatg
1441 agtgtgcaat tgagagcata gcagtggcag ccacaccaat tcctaaattg tagggtatgc
1501 cttccagtat ttcataatga tctgcatcag ttgtaaaggg gaattggtat attcacagac
1561 tgtagacttt cagcagcaat ctcagaagct acaaataga tttccatgaa gatatttgtc
1621 ttcagaatta aaactgccct taattttaat atacctttca atcggccact ggccattttt
1681 ttctaagtat tcaattaagt gggaattttc tggaagatgg tcagctatga agtaatagag
1741 tttgcttaat catttgtaat tcaaacatgc tatatttttt aaaatcaatg tgaaaacata
1801 gacttatttt taaattgtac caatcacaag aaaataatgg caataattat caaaactttt
1861 aaaatagatg ctcatatttt taaaataaag ttttaaaaat aactgcaaaa aaaaaaaaaa
1921 aaaa
```

SEQ ID NO:1

Figure 5: Cathepsin C human protein sequence according to Swiss-prot P53634

MGAGPSLLLA ALLLLLSGDG AVRCDTPANC TYLDLLGTWV FQVGSSGSQR DVNCSVMGPQ 70      80      90      100      110      120

EKKVVVYLQK LDTAYDDLGN SGHFTIIYNQ GFEIVLNDYK WFAFFKYKEE GSKVTTYCNE 130      140      150      160      170      180

TMTGWVHDVL GRNWACFTGK KVGTASENVY VNTAHLKNSQ EKYSNRLYKY DHNFVKAINA 190      200      210      220      230      240

IQKSWTATTY MEYETLTLGD MIRRSGGHSR KIPRPKPAPL TAEIQQKILH LPTSWDWRNV 250      260      270      280      290      300

HGINFVSPVR NQASCGSCYS FASMGMLEAR IRILTNNSQT PILSPQEVVS CSQYAQGCEG 310      320      330      340      350      360

GFPYLIAGKY AQDFGLVEEA CFPYTGTDSP CKMKEDCFRY YSSEYHYVGG FYGGCNEALM 370      380      390      400      410      420

KLELVHHGPM AVAFEVYDDF LHYKKGIYHH TGLRDPFNPF ELTNHAVLLV GYGTDSASGM 430      440      450      460

DYWIVKNSWG TGWGENGYFR IRRGTDECAI ESIAVAATPI PKL

SEQ ID NO: 2

Figure 6: Primers for detecting human Cathepsin C cDNA forward: 5'-gctccctgcagcatgggtgctgggccctcc-3' (SEQ ID NO.4)

reverse: 5'-gcataccctacaatttaggaattggtgtgg-3' (SEQ ID NO.5)

Figure 7: Probe for detecting mouse Cathepsin C

GGCCAGTGAATTGTAATACGACTCACTATAGGGAGGCGGT      SEQ ID NO.6

CATHEPSIN C-BASED SCREENING METHODS FOR IDENTIFYING MODULATORS OF PAIN

Present invention concerns the use of Cathepsin C. Other aspects of the invention concern methods for screening pharmaceuticals, for diagnosing pain susceptibility and for the treatment of pain.

In the western world, chronic pain is a major unsolved health problem undermining the health and welfare of millions of citizens. Chronic pain severely afflicts the well-being of the individual experiencing it and it is frequently accompanied or followed by vegetative signs, which often result in depression. Chronic pain results in individual suffering and social economic costs of tremendous extent. Existing pharmacological pain therapies are widely unsatisfying both in terms of efficacy and of safety.

In light of the severe drawbacks connected with state of the art pain treatments, there is a great need for novel options for treatment of ongoing pain, and for diagnosis and prognosis concerning the potential development of chronic pain. Especially in light of the vast gap between the fast advancing understanding of the neurobiology of pain and the unmet clinical need to provide effective treatments without the drawbacks of state of the art treatments, efforts need to be directed to the discovery of new targets for novel classes of analgesics.

Thus, it is the object of the present invention to provide a new means for the development and provision of new classes of pain modulating drugs.

This object is solved by the use of Cathepsin C or functional fragments or derivatives thereof for identifying compounds that modulate pain.

The invention is based on the surprising finding of the inventors, demonstrating for the first time that Cathepsin C expression closely correlates with pain susceptibility in mouse models of neuropathic pain.

Pain is, per definition of the international association for the study of pain, an unpleasant sensory and emotional experience associated with actual or potential tissue damage, or described in terms of such damage. Pain is normally the consequence of an activation of the nociceptive nervous system, that is specialized to detect and encode damage or potential damage of tissue. Pain is thus part of a warning system of the body to initiate reactions for minimizing actual or potential damage to the body. Pain can be the primary symptom of a medical condition or can be secondary effect of a diseased state, often without any biological meaning.

Pain may be acute or chronic. Acute pain is a physiological signal indicating a potential or actual injury. It occurs accompanying tissue damage, infection, inflammation or other acute causes, alerting the individual after bodily damage or malfunction. If acute pain is not treated properly, it may lead to chronic pain.

Chronic pain is a diseased state with varying origin, duration, intensity and specific symptoms.

Chronic pain may be of nociceptive origin, inflammatory or neuropathic. Nociceptive pain is judged to be commensurate with ongoing activation of somatic or visceral pain-sensitive nerve fibers. Neuropathic pain is pain resulting from any kind of damage to peripheral or central neuronal tissue; it is believed to be sustained by aberrant somatosensory processes in the peripheral nervous system, the CNS, or both. (For an overview of pain mechanisms, see for example Scholz and Woolf, 2002; Julius and Basbaum, 2001, Woolf and Mannion, 1999; Wood, J. D., 2000; Woolf and Salter, 2000.)

Chronic neuropathic pain is variable from patient to patient. Recent data indicate that individual pain susceptibility plays an important role for the amount of individual suffering, i.e. there is an important heritable predisposition to pain, particularly to the development of neuropathic pain. Present invention is based on extensive studies of the inventors which aimed to identify pain susceptibility genes (i.e. genes that determine the amount of pain felt in the presence of a given, fixed degree of tissue injury) in rodent models of chronic pain. The rodent models and experimental settings used by the inventors allowed for experimental conditions where among the different individuals a) nature and uniformity of the neural lesion can be precisely controlled and b) genetic and environmental variability can be minimized.

Cathepsin C(CTSC; alternative titles: dipeptidyl(amino) peptidase I, DPPI; (EC 3.4.14.1)), is a lysosomal protease.

The gene locus of Cathepsin C is on chromosome 11q14.1-q14.3 (see Rao et al., 1997). The genomic sequence of Cathepsin C is publicly available at the NCBI nucleotide database under: NW_925129 (genomic sequence comprising the sequence of human Cathepsin C, SEQ ID NO:3) or NW_001030863 (genomic DNA sequence comprising mouse Cathepsin C)

The coding polynucleotide sequence of Cathepsin C is publicly available at the NCBI nucleotide database under several accession numbers, such as: NM_001814 (*Homo sapiens* cathepsin C transcript variant 1 mRNA), BC113897 (complete coding sequence (cds) of *Homo sapiens* cathepsin C, transcript variant 2, mRNA), BC109386 (*Homo sapiens* cathepsin C, mRNA, complete cds), NM_009982 (mus musculus cathepsin C mRNA). The skilled person knows how to retrieve further coding sequences of cathepsin C from the NCBI database (cathepsin C of other species; mutants or different isoforms of cathepsin C, if existing). If in the following, it is referred to the cathepsin C coding sequence, this can mean any of the above mRNA or coding sequences; preferably, the sequence according to reference numbers NM_001814 (human) (SEQ ID NO: 1) or NM_009982 (mouse) is meant.

The protein sequence of Cathepsin C is publicly available at the NCBI protein database, e.g. under the following accession numbers: *homo sapiens* (hs): complete cds: CAA6067, AAL48191, AAL48192, AAL38195, AAH54028, AAQ08887, AAI00893, AAI00894, AAI00892, AAI00895, AAI09387, AAI10072, AAI13851; hs isoform CRA_b: EAW59364; hs isoform CRA_a: EAW59363; hs cathepsin C isoform a preproprotein: NP_001805; hs isoform b precursor: AAI13898 or NP_680475. Murine (mus musculus) cathepsin C: AAH67063; preproprotein: NP_034112; isoform CRA-b (mus musculus): EDL06796; isoforms CRA-a (mus musculus): EDL06795. Moreover the protein sequence is publicly available at the UniProtKB database (www.beta.uniprot.orq), under accession numbers: P53634 (HUMAN_CATC, human Cathepsin C, SEQ ID NO:2), or P97821 (CATC_MOUSE, murine Cathepsin C). If in the following, it is referred to the cathepsin C protein or amino acid sequence, this can mean any of the above protein sequences; preferably, the sequence according to reference numbers P53634 (for the human sequence) or P97821 (for the murine sequence).

NCBI is the national centre for biotechnology information (postal address: National Centre for Biotechnology Information, National Library of Medicine, Building 38A, Bethesda, Md. 20894, USA; web-adress: www.ncbi.nhm.nih.qov). More sequences (e.g. sequences carrying SwissProt or EMBL accession numbers) can be retrieved in the UniProtKB database under www.beta.uniprot.org.

The cloning of hs Cathepsin C is published by Paris et al., 1995, the cloning of murine cathepsin C is published by Pham et. al, 1997. The 5"flanking region (promoter/enhancer) is published by Rao et. al, 1997 (see especially page 10263, FIG. 4 and the detailed text on the lower part of said page, which is incorporated herein by reference; e.g. the gene sequence starting from −1127 up to to +1). Cathepsin C is expressed at high levels in lung, kidney and placenta, and to a lesser extent in a variety of other organs, including cells of the immune system (Rao et. al., 1997).

Cathepsin C is a lysosomal protease capable of removing dipeptides from the amino terminus of protein substrates. Cathepsin C is involved in the activation of granule serine proteases, which are expressed in bone marrow-derived effector cells of the immune system; and it is involved for processing and activation of the T-lymphocyte granzymes A (GZMA) and B (GZMB) and granzyme C; further functions are the processing of different lysosomal cathepsins, the activation of different serine proteases (chymotrypsin-like serine proteases) by removal of an inhibitory N-terminal dipeptide residue (such as the above granzymes, Cathepsin C itself, neutrophil elastase, proteinase-3, mast cell chymase and tryptase (Toomes et al., 1999, Pham and Ley 1999, Turk et al, 2000, Henningsson et al, 2003; McGuire et al., 1993; Adkison et al., 2002; Wolters et al, 2001; Pham et al, 2004; DeHaar et al, 2004; Sheth et al, 2003, Methot et al., 2007). Its functions in general comprise: protease activity, peptidase activity, e.g. dipeptidylpeptidase, exopeptidase or endopeptidase activity; activation of serine proteases (e.g. one or more of the following: elastase, cathepsin G and granzymes A and B, neuraminidase and factor XIII).

Cathepsin C is a 200 kD tetrameric protein (Paris et al., 1995), which stands in contrast to other cathepsins (e.g. cathepsin B, H, L and S) being small monomeric enzymes. The cathepsin C protein is processed from a prepro-form to a proteolytically active enzyme. The mature monomeric form of cathepsin C consists of a heavy chain, a light chain and a propeptide remaining associated with the active enzyme (Wolters et al., 1998; Cigic et al., 2000); four of such cathepsin C monomers forming the proteolytically active, 200 kD cathepsin C tetramer.

The generation of cathepsin C knock-out mice (Dppi-knock out mice) is published by Pham and Ley, 1999 (see materials and methods part, from p. 8627 go 8629 and esp. p. 8627, second half of right column to p. 8628, first half of left column for construction of the DPPI targeting vector and generation of DPPI −/− mice; see as well Heusel et al, 1994; Mansour et al., 1988 and Soriano et al., 1991, to which Pham and Ley, 1999, refers for embryonic stem cell generation).

The use according to present invention allows for the identification of novel substances for the prevention and/or treatment of pain, especially neuropathic pain. The use according to present invention comprises the identification of compounds with desired characteristics (i.e. lowering the pain sensation) as well as the identification of compounds with undesired characteristics (i.e. increasing the pain sensation). Moreover, present invention allows for the further characterisation of compounds already identified of being useful for the prevention and/or treatment of any disease or diseased state. In this case, present invention can e.g. be used for excluding identified active compounds having unwanted side-effects (i.e. the increase of pain sensation): Candidate compounds for a given disease can e.g. be profiled for their influence on Cathepsin C (protein and/or nucleic acid, expression and/or function, etc.).

A compound/test compound/active compound as to be employed for the different aspects of present invention can be any biological or chemical substance or natural product extract, either purified, partially purified, synthesized or manufactured by means of biochemical or molecular biological methods.

A compound considered as being active in modulating pain in the sense of the different aspects of present invention can be any substance having an influence on one of the functions of Cathepsin C or on the Cathepsin C amount (protein or nucleic acid) in a cell, on Cathepsin C expression, posttranslational modification (e.g. N-glycosilation or processing (e.g. cleavage og the exclusion domain, e.g. at position 58 or 61)), oligomerization of the monomers, protein folding or activation.

To this end, the substance can modulate any of the functions of Cathepsin C (e.g. those as listed above or below). Cathepsin C protein activity can be modulated by the substance e.g. by direct interaction and interference of Cathepsin C polypeptide/protein or fragments thereof. The substance can also modulate Cathepsin C expression, e.g. on the level of transcription (initiation, elongation, processing, etc), transcript stability, translation. Moreover it can modulate the posttranslational modification, the processing from the inactive to the active form (cleavage of the prepro-form to the three polypeptides forming the active monomer) and/or the oligomerization from the monomeric to the tetrameric form, as well as protein folding etc. of Cathepsin C. The substance can exert the above effects directly or indirectly (indirectly meaning i.e. by interfering (positively or negatively) with natural signalling cascades having influence on Cathepsin C function/protein activity/expression etc.)

Functions of Cathepsin C comprise those as listed above, e.g. protease activity; the ability of removing dipeptides from the amino terminus of one or more protein substrates; the ability to interact specifically with one or more protein substrates (protein-protein interaction), such as those listed above; the ability to cleave and/or activate one or more protein substrates, such as those listed above; the ability to process protein substrates, such those listed above.

Functions of Cathepsin C comprise also generally the ability of Cathepsin C protein or nucleic acid or fragments thereof to interact with other molecules (comprising, but not limited to: proteins, nucleic acids, synthetic molecules) and preferably concern its capability of interacting and cleaving protein substrates.

Substrate of an enzyme is understood, within the terms of present application, to be any molecule that can be modified by the enzyme. Naturally occurring substrates in the scope of present invention are molecules that correspond to the form in which they occur in the natural physiological or pathological context (such as granule serine proteases, GZMA, GZMB), and which are also capable of being modified by the respective enzyme.

The modulation of pain can be either a decrease or an increase.

According to one aspect of present group of inter-related inventions, a fragment or derivative of Cathepsin C can be used. A fragment can be a fragment of a protein, polypeptide or polynucleic acid.

A fragment of a protein or polypeptide is a protein or polypeptide that carries one or more end-terminal (n- and/or c-terminal) and/or internal deletions of one, two or more amino acids, when compared to the full-length Cathepsin C; fragments comprise, e.g.

1. a Cathepsin C fragment carrying an n-terminal deletion of the dipeptide Xaa-Yaa, Zaa- in its Amino Acid chain, especially except when Xaa is Arg or Lys, or Yaa or Zaa is Pro;

2. a Cathepsin C fragment in which the Signal peptide (Amino Acids 1-24 of the Amino Acid chain) is deleted or Cathepsin C fragment consisting of amino acids 25-463
3. a Cathepsin C fragment comprising or consisting of positions 25-134 of the Amino Acid chain according to SEQ ID NO:2 (dipeptidyl-peptidase 1 exclusion domain chain)
4. a Cathepsin C fragment in which the propeptide (Amino Acids 135-230 is deleted)
5. a Cathepsin C fragment comprising or consisting of the dipeptidyl peptidase 1 heavy chain (Amino Acids 231-394);
6. a Cathepsin C fragment comprising or consisting of the dipeptidyl peptidase 1 light chain (Amino acids 395-463)
7. a Cathepsin C fragment comprising the dipeptidyl peptidase 1 light chain (Amino acids 395-463) and heavy chain (Amino Acids 231-394);
8. a Cathepsin C fragment comprising the dipeptidyl peptidase 1 light chain (Amino acids 395-463) and heavy chain (Amino Acids 231-394);

The positions of the above fragments refer to SEQ ID NO:2; preferred examples of the above fragments concern fragments of the protein according to SEQ ID NO:2.

A functional fragment of Cathepsin C protein is any fragment of this protein having at least one or more of the functional characteristics of the full-length protein, especially as listed above.

A fragment of a polynucleotide acid is a polynucleotide acid or an oligonucleotide carrying one or more end-terminal (5'- and/or 3'-) and/or internal deletions of one, two or more nucleotides, when compared to the full-length genomic or coding sequence. A functional fragment of Cathepsin C nucleic acid is any fragment having at least one or more of the functional characteristics of the full-length polynucleic acid (mRNA, genomic or coding sequence).

The term derivative of Cathepsin C comprises any type of modification of Cathepsin C in comparison to the naturally-occurring form, and especially in comparison to Cathepsin C according to SEQ ID NO:1 or SEQ ID NO 2, that is not a deletion. A functional derivative of Cathepsin C is any derivative of this protein having at least one and preferably two or more of the functional characteristics of the unmodified protein. Derivatives comprise, e.g. modifications of the amino acid or nucleotide sequence or any other kind of modification such as a chemical or biological modification leading e.g. to the stabilization of the polypeptide or polynucleotide (such as phosphoorothioate modifications of the nucleic acid backbone or of exchanges of the bonds between amino acids, etc), or enabling a specific targeting of the plypeptide or polynucleotide to certain cells or facilitating its entry into or its uptake by cells (such as cell-permanent phosphopeptides, ortho coupling to cell-permeant peptide vectors, e.g. based on the antennapedia/penetrating, TAT and signal-peptide based sequences; or coupling to parts of ligands for specific transporters or importers).

Present invention also comprises functional derivatives of fragments of Cathepsin C.

Another aspect of present invention concerns the use of a non-human transgenic animal heterologously expressing Cathepsin C or a functional fragment thereof for identifying or analyzing compounds that modulate pain.

The non human animal can be any non human animal. Preferred are rodents, such as rats or mice.

A transgenic animal is an animal that carries in its genome foreign DNA, which has deliberately been transferred thereto. The introduction of the foreign DNA into the animal genome can be performed according to standard procedures (see e.g. Transgenic Animal Technology A Laboratory Handbook. C. A. Pinkert, editor; Academic Press Inc., San Diego, Calif., 1994 (ISBN: 0125571658).

The term heterologous expression refers to an expression differing from the normal gene expression in the host organism (concerning steady state level, amount, timing or tissue distribution of the expressed gene or concerning the type of expressed gene (i.e. the gene is normally not expressed in the host at all)). The heterologous expression can be constitutive or inducible. Suitable inducible expression systems are well known in the art (e.g. the Tetracycline inducible system or the like). The organism can be a cell or a non-human animal.

According to another aspect, present invention concerns the use of a non-human transgenic animal heterologously expressing Cathepsin C or a functional fragment thereof as a model system for enhanced pain sensitivity.

Yet another aspect of present invention concerns the use of a non-human Cathepsin C knock-out animal for identifying or analyzing compounds that modulate pain.

A knock-out organism (such as an animal or a cell) refers to an organism in which the expression or function of a gene is partially or completely deleted and comprises genomic as well as functional knock outs, inducible as well as constitutive knock outs. The generation of knock out organisms is well known in the art, as well as cells or animals which can be used for generating knock out organisms. The generation of cathepsin C—knock out mice is described in Pham and Ley, 1999.

A further aspect of present invention concerns use of a non-human Cathepsin C knock-out animal as a model system for lowered pain sensitivity.

The use of a cell heterologously expressing Cathepsin C or a functional fragment thereof for identifying compounds that modulate pain, is another aspect of present invention.

The cell can be any prokaryotic or eucaryotic cell, such as cells capable of being transfected with a nucleic acid vector and of expressing a reporter gene. These comprise principally primary cells and cells from a cell culture, such as a eukaryotic cell culture comprising cells derived either from multicellular organisms and tissue (such as HeLA, CHO, COS, SF9 or 3T3 cells) or single cell organisms such as yeast (e.g. *S. pombe* or *S. cerevisiae*), or a procaryotic cell culture, preferably *Pichia* or *E. coli*. Cells and samples derived from tissue can be gained by well-known techniques, such as taking of blood, tissue punction or surgical techniques.

According to one embodiment, a modified cell, having a lower Cathepsin C activity as compared to its unmodified state, is used. This way, it can e.g. be tested, if the chemical compounds to be tested are able to enhance or restore the lowered or totally abolished Cathepsin C activity. Or it can be tested whether the substances are able to perform their function (e.g. pain modulation or even a function in the context of another diseased state or disease) in the context of lowered pain sensitivity.

The modification can be any type of modification (stable or transient, preferably stable), that leads to a decrease of Cathepsin C activity, Cathepsin C transcript steady state level (i.e. by activation of Cathepsin C transcription or transcript stabilisation) or Cathepsin C protein steady state level (i.e. by activation of Cathepsin C translation or its posttranslational processing; by modulation of Cathepsin C posttranslational modification or by activation of its stabilisation or by inhibition of its degradation). This can for example be achieved by using dominant negative mutants of Cathepsin C, antisense oligonucleotides, RNAi constructs of Cathepsin C, by generating functional or genomic Cathepsin C knock outs (which can e.g. be inducible) or other suitable techniques known within the state of the art. For an overview of the above techniques, see for example: Current protocols in Molecular biology (2000) J. G. Seidman, Chapter 23, Supplemtent 52, John Wiley and Sons, Inc.: Gene Targeting: a practical approach (1995), Editor: A. L. Joyner, IRL Press; Genetic Manipulation of Receptor Expression and Function, 2000; Antisense Therapeutics, 1996; Scherr et al, 2003.

According to one embodiment, a Cathepsin C knock-out cell is used. Suitable cell lines for the generation of knock-outs are well known in the state of the art, see e.g., Current protocols in Molecular Biology (2000) J. G. Seidman, Chapter 23, Supplement 52, John Wiley and Sons, Inc; or Gene Targeting a practical approach. (1995) Ed. A. L. Joyner, IRL Press. The generation of Cathepsin C (DPPI) knock-out cells is also published in Pham and Ley, 1999 (the generation of DPPI murine embryonic stem cell knock out clones, see page 8628, left column, upper half).

Another aspect of the invention concerns thus the use of a Cathepsin knock-out cell for identifying or analyzing compounds that modulate pain.

Furthermore, the use of a Cathepsin knock-out cell as a model system for lowered pain sensitivity, is another aspect of present group of inter-related inventions.

According to another embodiment of present invention, the cell can have a higher amount of Cathepsin C as compared to a reference cell (e.g. the same cell in its unmodified state). This cellular system can serve to mimic a state of enhanced pain sensitivity, as the amount of Cathepsin C expression is related to pain sensitivity.

Present invention relates thus also to the use of a cell heterologously expressing Cathepsin C or a functional fragment thereof as a model system for enhanced pain sensitivity.

The use of a cell heterologously expressing a reporter gene expressibly linked to the Cathepsin C promoter and/or enhancer or a functional fragment thereof for identifying or analyzing compounds that modulate pain.

The above aspect of present invention is based on a typical reporter gene assay commonly known in the art. To this end, the promoter of choice is inserted into an expression vector suitable for the type of host cell chosen, upstream of the reporter gene of choice in such a way as to allow for an expression of the reporter gene if the promoter is active. The construct is subsequently introduced into the host cell of choice. Suitable methods for transformation or transfection are well known in the art as well as conditions for cell cultivation and detection of reporter gene expression (see e.g. standard literature listed below). Suitable conditions are well known in the art as well as vectors, reporter genes and necessary reagents, which are also commercially available.

A vector is a circular or linear polynucleotide molecule, e.g. a DNA plasmid, bacteriophage or cosmid, by aid of which polynucleotide fragments (e.g. cut out from other vectors or amplified by PCR and inserted in the cloning vector) can specifically be amplified in suitable cells or organisms. Expression vectors enable the heterologous expression of a gene of interest (e.g. a reporter gene), in the host cell or organism. The type of cell or organism largely depends on the aim and the choice lies within the knowledge of the skilled artisan. Suitable organisms for the amplification of a nucleic acid are e.g. mostly single cell organisms with high proliferation rates, like e.g. bacteria or yeast. Suitable organisms can also be cells isolated and cultivated from multicellular tissues, like e.g. cell lines generated from diverse organisms (e.g. SF9 cells from *Spodoptera Frugiperda*, etc.). Suitable cloning vectors are known in the art and commercially available at diverse biotech suppliers like, e.g. Roche Diagnostics, New England Biolabs, Promega, Stratagene and many more. Suitable cell lines are e.g. commercially available at the American Type Culture Collection (ATCC).

For the heterologous expression of a protein or polypeptide, the cell can be any prokaryotic or eucaryotic cell capable of being transfected with a nucleic acid vector and of expressing the gene of interest, e.g. a reporter gene. These comprise principally primary cells and cells from a cell culture, preferably an eukaryotic cell culture comprising cells derived either from multicellular organisms and tissue (such as HEK293, RIN-5F, HeLA, CHO, COS, SF9 or 3T3 cells) or single cell organisms such as yeast (e.g. *S. pombe* or *S. cerevisiae*), or a procaryotic cell culture, preferably *Pichia* or *E. coli*. Cells and samples derived from tissue can be gained by well-known techniques, such as taking of blood, tissue punction or surgical techniques.

Within the context of present application, the term "transfection" refers to the introduction of a nucleic acid vector into a host cell (either prokaryotic or eucaryotic) and comprises thus the term "transformation".

The transfection can be a stable or transient transfection.

The Cathepsin C promoter is a part of the Cathepsin C gene able to drive expression of a gene product of interest if introduced into a suitable expression vector upstream of the coding sequence of the gene product. Preferably, the Cathepsin C promoter comprises or consists of the sequence according to nucleotides −1127 to +1 of the sequence as published by Rao et al., 1997, page 10263, FIG. 4. A functional fragment of the Cathepsin C promoter is any fragment of the Cathepsin C promoter that is able to drive expression of a gene product of interest if introduced into a suitable expression vector upstream of the coding sequence of the gene product. Preferable fragments comprise functional fragments of the Cathepsin C promoter as published by Rao et al., 1997, p. 10263, FIG. 4.

A reporter gene can be any gene that allows for an easy quantification of its gene product. A vast variety of reporter genes for eukaryotic or prokaryotic hosts as well as detection methods and necessary reagents are known in the art and commercially available. These comprise e.g. the genes of beta Lactamase (lacZ), Luciferase, Green or Blue fluorescent protein (GFP or BFP), DsRed, HIS3, URA3, TRP1 or LEU2 or beta Galactosidase. These genes encode proteins which can be easily detected by means of a visible (colour or luminescent) reaction (e.g. lacZ, Luciferase). These comprise gene-products which can be easily detected by means of a visible (colour or luminescent) reaction or gene-products conferring resistance towards antibiotics like Ampicillin or Kanamycin when expressed. Other reporter gene-products enable the expressing cells to grow under certain conditions like e.g. auxotrophic genes.

A functional fragment of a reporter gene is any fragment of a given reporter gene that allows for an easy quantification of its gene product.

The cell can be any prokaryotic or eucaryotic cell capable of being transfected with a nucleic acid vector and of expressing a reporter gene. These comprise principally primary cells and cells from a cell culture, preferably a eukaryotic cell culture comprising cells derived either from multicellular organisms and tissue (such as HeLA, CHO, COS, SF9 or 3T3 cells) or single cell organisms such as yeast (e.g. *S. pombe* or *S. cerevisiae*), or a procaryotic cell culture, preferably *Pichia* or *E. coli*. Cells and samples derived from tissue can be gained by well-known techniques, such as taking of blood, tissue punction or surgical techniques.

Within the context of the above aspect of present invention the control vector can be any suitable vector which comprises a reporter gene or functional fragment thereof, but wherein reporter gene expression is not driven by a (functional) Cathepsin C promoter. This can e.g. mean that the reporter gene or functional fragment thereof is not operationally coupled to a functional Cathepsin C promoter (i.e. either totally devoid of a Cathepsin C promotor, comprises a non functional Cathepsin C promoter or promoter fragment or wherein the coupling of promoter and reporter gene is not functional). Another possibility is that the reporter gene or functional fragment thereof is operationally coupled to another promoter than the Cathepsin C promoter (e.g. SV40 or another standard promoter). The functional vector and the control vector can also be transfected to the same cell, but in which case the reporter genes need to be different.

The identification of compounds according to the above uses can e.g. be performed according to assays as described below or as known in the art.

An assay is any type of analytical method or system to monitor a biological process. Suitably, molecular cascades and mechanisms representing parts of physiological metabolic pathways but also of pathological conditions are reproduced in cellular or biochemical (in vitro) systems. The pharmacological activity of a potential pharmaceutical compound can thus be determined according to its capability of interfering with or modulating these cascades or mechanisms.

For the use in drug screening, especially the high throughput screening for novel pharmaceutical compounds, the assay needs to be reproducible and is preferably also scalable and robust. In the scope of present invention, high throughput screen means, that a method according to present invention is performed in a very small scale, e.g. on 96, 386 or 1536 well plates in samples of very small volume in the range of few millilitres down to few nanoliters or even less. Thus, a very large amount of samples can be analysed in a short time. High throughput screening mostly comprises the screening of approximately 500.000 different compounds for a certain ability by means of one single assay. The assay is preferably suitable for high throughput screening of chemical substances for their ability of modulating the activity of the target molecule under investigation. The type of assay depends e.g. on the type of target molecule used (e.g. polypeptide or polynucleotide) and the "read out", i.e. the parameter, according to which the activity of the target molecule is determined (see below).

Different types of such assays are commonly known in the state of the art and commercially available from commercial suppliers.

Suitable assays for different purposes encompass radioisotopic or fluorescent assays, for example fluorescence polarization assays (such as those offered commercially by Panvera) or Packard BioScience (HTRF; ALPHAScreen™) for measuring the interaction of a labeled member with a non-labeled member (e.g. the interaction of labeled proteins with their unlabeled protein-ligands).

More examples include cell based assays, wherein a cell line stably (inducibly or not; chromosomal or episomal) or transiently expresses a recombinant protein of interest. These assays comprise e.g. reporter gene assays, wherein the regulation of a certain promotor or a signal transduction pathway of a member of a signal transduction cascade is measured according to the activity of a reporter enzyme, the expression of which is under the control of said certain promotor. For this type of assay, a recombinant cell line has to be constructed containing the reporter gene under the control of a defined promotor that is to be investigated itself or that is regulated by the signaling cascade under investigation. Suitable reporter enzymes are commonly known within the state of the art and comprise firefly luciferase, renilla luciferase (e.g. commercially available by Packard reagents), β-Galactosidase. Suitable cell lines depend on the aim of the assay but comprise mostly cell lines that are easy to transfect and easy to cultivate, such as, e.g. HeLA, COS, CHO, NIH-3T3, etc.

For determination of protease activity, typical protease assay formats are known: e.g. using a substrate carrying a reporter tag (e.g. a luminescent/fluorescent or other signal emitting protein/peptide or entity) at one position of the substrate and a quencher (an entitiy (e.g. another peptide inhibiting the signal emission of the reporter tag as long as the substrate is intact/uncleaved) at another position; the substrate is incubated with Cathepsin C under suitable conditions to allow for the cleavage of the substrate leading to the emission of a detectable signal (e.g. light-emission), because of the separation of quencher and reporter tag.

Other types of assays and other types of "read out" are well known in the state of the art.

Assays according to present invention concern:

A method of identifying or analyzing compounds modulating and/or preventing pain, comprising the steps
 a. Providing at least two samples;
 b. Contacting one sample containing Cathepsin C or a functional fragment or derivative thereof with a compound,
 c. determining the activity of Cathepsin C in the presence of compound,
 d. determining the activity of Cathepsin C in the absence of compound, and
 e. comparing the activity of Cathepsin C according to c) with that according to d).

A method for identifying or analyzing compounds that modulate and/or prevent pain comprising:
 a. Contacting a Cathepsin C protein or functional fragment or derivative thereof with a test compound; and
 b. Determining whether the test compound modulates the activity of the Cathepsin C protein or functional fragment or derivative thereof.

A method for identifying or analyzing compounds that modulate and/or prevent pain comprising:
 a. Contacting a cell, which has a detectable amount or activity of Cathepsin C or of a functional fragment or derivative thereof, with a test compound;
 b. Determining whether the test compound is able to modulate the amount or activity of Cathepsin C or the functional fragment or derivative thereof present in the cell.

A method for identifying or analyzing compounds that modulate and/or prevent pain comprising:
 a. Contacting a nucleic acid coding for a Cathepsin C protein or a functional fragment or derivative thereof with a test compound in a transcriptionally active system, and
 b. Determining the amount of mRNA coding for the Cathepsin C protein or the functional fragment or derivative thereof present in said system in presence of said compound, and
 c. Determining whether the compound is capable of modulating the amount of mRNA coding for the Cathepsin C protein or functional fragment or derivative present in said system.

A transcriptionally active system is any biochemical or cellular system which at least has the ability to perform a transcription reaction of a transcription unit. Such systems are well known in the art and comprise cells as well as in vitro transcription systems or kits (e.g. on basis of cell extracts) commercially available.

A method for identifying compounds or analyzing compounds that modulate and/or prevent pain comprising:

a. Providing a cell transfected with a nucleic acid vector comprising the promoter of a Cathepsin C gene or a functional fragment thereof operationally coupled to a reporter gene or a functional fragment thereof;
b. Providing a cell transfected with a control vector which comprises a reporter gene or a functional fragment thereof not being operationally coupled to a functional Cathepsin C promoter;
c. Determining the reporter gene activity of the cell according to a) and b) in the presence of a test compound;
d. Determining the reporter gene activity of the cell according to a) and b) in absence of the test compound.

A method for identifying or analyzing a compound that modulates pain comprising
a. Selecting a compound that modulates the activity of Cathepsin C as a test compound, and
b. Administering said test compound to a subject in sensation of pain to determine whether the pain is modulated.

A method of identifying or analyzing a compound that modulates and/or prevents pain in a subject comprising:
c. Assaying a biological activity of Cathepsin C or a functional fragment or derivative thereof in the presence of one or more test compounds to identify one or more modulating compounds that modulate the biological activity of Cathepsin C, and
d. Testing one or more of the modulating compounds for their ability to reduce pain, pain sensation or pain sensitivity in a subject.

Further aspects of present invention concern pharmacogenomic methods for classifying patient groups and assisting the physician to adapt/improve his treatment of individual patients, such as:

A method for analyzing the pain threshold in an individual comprising analyzing the amount of Cathepsin C in a taken sample of said individual in comparison to one or more reference samples as to whether the amount of Cathepsin C mRNA and/or protein present in said sample is different from that of one or more reference samples, wherein the presence of a higher amount indicates an increased pain sensitivity and the presence of a lower amount indicates a decreased pain sensitivity in said individual.

A method for adapting the dosage of a pharmaceutical for the prevention and/or treatment of pain in an individual, which method comprises examining a taken sample of an individual as to whether the amount of Cathepsin C mRNA and/or protein present in said sample is different from that of one or more reference samples, said dosage being adapted depending on whether the amount of protein and/or mRNA in the taken sample of the individual is different from that of the one or more reference samples, wherein a higher amount of Cathepsin C in the taken sample of the individual is indicative of a need for a higher dose and a lower amount of Cathepsin C in the sample of the individual is indicative of a need for a lower dose.

The term "taken sample" as used herein, refers to a biological sample taken/separated from the body of one or more individual beings (humans or non-human animals). Biological material and biological samples comprise, e.g. cells, preparations or parts of tissue or organs (e.g. brain, blood, liver, spleen, kidney, heart, blood vessels, etc.), preferably if derived from a vertebrate, and more preferably from a mammal including a human. Comprised are also cells from a cell culture, preferably a eukaryotic cell culture comprising cells derived either from multicellular organisms and tissue (such as HeLa, CHO, COS, SF9 or 3T3 cells) or single cell organisms such as yeast (e.g. *S. pombe* or *S. cerevisiae*), or a procaryotic cell culture, preferably *Pichia* or *E. coli*. Cells and samples derived from tissue can be gained by well-known techniques, such as taking of blood, tissue punction or surgical techniques. The preparation of recombinant molecules and the purification of naturally occurring molecules from cells or tissue, as well as the preparation of cell- or tissue extracts is well known to the person of skill in the art (see e.g. also the standard literature listed below).

The term "reference sample" refers to a biological sample taken from one or more individuals with a known given pain phenotype or to an in vitro biological sample (e.g. a sample stemming from in vitro cell or tissue culture (e.g. cultivated cells)) and corresponding in certain characteristics (e.g. its level of Cathepsin C activity, amount or expression) to a given pain phenotype (e.g. high pain sensitivity or low pain sensitivity).

Yet another aspect of present invention concerns the use of a means for the detection of Cathepsin C for determining enhanced pain sensitivity in an individual by analyzing a biological sample taken from the body of an individual to be examined.

The means for the detection of Cathepsin C can be any means able to specifically detect Cathepsin C polypeptide/protein or nucleic acid present in a biological sample.

A means to specifically detect Cathepsin C protein or polypeptide can be any means able to specifically detect either wildtype Cathepsin C protein/polypeptide and can also be a means to detect specifically Cathepsin C protein/polypeptide harbouring one or more mutations regarding the size or the amino acid sequence in comparison to a wild type polypeptide/protein. A preferred examply of such a means is an antibody able to specifically detect Cathepsin C protein, e.g. for use in immunohistological or immunohistochemical techniques (e.g. detection of Cathepsin C protein or certain mutations thereof in histological tissue sections or cathepsin C protein immobilized on suitable carriers like membranes, chips, ELISA plates etc.). CathepsinC antibodies are commercially available, such as Goat Anti-Human Cathepsin C, Catalog# AF1071, R&D Systems (Minneapolis, USA), Goat Anti-Mouse Cathepsin C, Catalog# BAF1034, R&D Systems (Minneapolis, USA).

The means to specifically detect Cathepsin C nucleic acid can e. g be a means to detect Cathepsin C mRNA/cDNA or genomic DNA, either wildtype or also harbouring one or more mutations regarding their length or their nucleic acid sequence in comparison to a wild type Cathepsin C nucleic acid. The means can e.g. be a means to specifically detect and/or quantify Cathepsin C mRNA and preferably comprises or is a specific Cathepsin C nucleic acid probe or a primer set capable of amplifying Cathepsin C DNA or, e.g. for use in PCR sequencing (for the detection of Mutations in the nucleotide sequence) or capable of amplifying Cathepsin C cDNA, e.g. for use in RT PCR (for the detection and/or quantification of Cathepsin C mRNA expression). Another means can e.g. be a nucleic acid probe able to specifically hybridise to Cathepsin C mRNA or cDNA under standard conditions, e.g. for use in Northern Blot or Chip hybridisation techniques.

The term wild type refers to the genotype or phenotype that is found in nature or in the standard laboratory stock for a given organism. According to one preferred embodiment, the wildtype sequences of Cathepsin C are the sequences according to SEQ ID NOs: 1, 2, 3.

The design and synthesis of suitable primers is well known in the art (see also above). According to a preferred embodiment of present invention, the means is a primer set for the amplification of Cathepsin C nucleic acid, such as human Cathepsin C nucleic acid, preferably a set of primers comprising at least one of the primers according to SEQ ID No. 4 and/or 5.

According to a further preferred embodiment of present invention, the means is a probe for the detection of Cathepsin C nucleic acid and preferably a probe having the sequence according to SEQ ID No. 6. The design and synthesis of suitable probes is well known in the art (see also standard literature below).

According to yet another preferred embodiment of present invention, the means is an antibody for the specific detection of Cathepsin C protein or polypeptide. The preparation of suitable antibodies or functional fragments thereof is well known in the art as well, e.g. by immunizing a mammal, for example a rabbit, with Cathepsin C protein or a fragment thereof, where appropriate in the presence of, for example, Freund's adjuvant and/or aluminium hydroxide gels (see, for example, Diamond, B. A. et al. (1981) The New England Journal of Medicine: 1344-1349). The polyclonal antibodies which are formed in the animal as a result of an immunological reaction can subsequently be isolated from the blood using well-known methods and, for example, purified by means of column chromatography. Monoclonal antibodies can, for example, be prepared in accordance with the known method of Winter & Milstein (Winter, G. & Milstein, C. (1991) Nature, 349, 293-299). Suitable procedures to produce monoclonal antibodies are well known in the art as well (see e.g. literature for standard methods listed below). In the context of present invention, the term antibody or antibody fragment comprises also antibodies or antigen-binding parts thereof, which have been prepared recombinantly and, where appropriate, modified, such as chimaeric antibodies, humanized antibodies, multifunctional antibodies, bispecific or oligospecific antibodies, single-stranded antibodies and F(ab) or F(ab)$_2$ fragments (see, for example, EP-B1-0 368 684, U.S. Pat. Nos. 4,816,567, 4,816,397, WO 88/01649, WO 93/06213 or WO 98/24884).

Another aspect of present invention concerns a diagnostic kit for determining the pain sensitivity in an individual, which test kit comprises at least one means for the detection of Cathepsin C in a biological sample.

In the context of the present invention, a test kit is understood to be any combination of the components identified in this application, which are combined, coexisting spatially, to a functional unit, and which can contain further components.

In the context of present invention, a test kit comprises at least a means for detection of Cathepsin C (e.g. amount/or mutation) in a biological sample, suitably together with suitable buffers and/or reagents for performing a detection reaction (e.g. immunological detection of Cathepsin C by means of an antibody, an enzymatic reaction for assaying Cathepsin C activity or the like), and/or sample preparation, and optionally a handling manual for performing the respective detection technique.

Other aspects of present invention concern methods of treatment, such as:

A method for treating pain in a subject that is experiencing pain comprising administering to said subject a therapeutically effective amount of a composition lowering the amount or activity of Cathepsin C in said subject. This can be the amount or activity of Cathepsin C altogether or in a certain tissue, e.g. in neural tissue, in lymphatic tissue or cells of the immune system such as mast cells, macrophages, neutrophils, T-cells (such as CD8+ T-cells), etc. wherein a therapeutically effective amount comprises an amount sufficient to ameliorate the pain sensation or sensitivity in the individual.

A method for lowering the pain sensitivity in a subject comprising administering to said subject a therapeutically effective amount of a composition lowering the amount (e.g. expression, half life) or activity of Cathepsin C in said subject (e.g. in lymphatic or neural tissue or cells of the immune system), concerns yet another aspect of present invention.

Moreover, present invention concerns a method for modulating the pain sensitivity in an offspring from a non-human female subject comprising transferring (e.g. electroporating) a nucleic acid conferring a modulated Cathepsin C expression into Zygotes, transferring the Zygotes into a non-human foster mother and electing offspring according to its Cathepsin C expression characteristics (lowered or abolished cathepsin C expression in comparison with wild type subjects, such as mice).

Another aspect of present invention concerns a compound that is able to lower Cathepsin C activity and/or expression for the treatment of pain.

Inhibitors of Cathepsin C are known in the art, such as peptide nitrile inhibitors (see e.g. Methot et al., 2007, which is incorporated herein by reference, see especially page 20839, FIG. 1 for structures of different Cathepsin C-inhibitors, such as Gly-Phe-DMK, Gly4-(I) Phe-DMK and compound 1* and compound 2* of said figure).

For the production of the medicament the modulators of Cathepsin C of the present invention can be formulated with suitable additives or auxiliary substances, such as physiological buffer solution, e.g. sodium chloride solution, demineralized water, stabilizers, such as protease or nuclease inhibitors, preferably aprotinin, ε-aminocaproic acid or pepstatin A or sequestering agents such as EDTA, gel formulations, such as white vaseline, low-viscosity paraffin and/or yellow wax, etc. depending on the kind of administration.

Suitable further additives are, for example, detergents, such as, for example, Triton X-100 or sodium deoxycholate, but also polyols, such as, for example, polyethylene glycol or glycerol, sugars, such as, for example, sucrose or glucose, zwitterionic compounds, such as, for example, amino acids such as glycine or in particular taurine or betaine and/or a protein, such as, for example, bovine or human serum albumin. Detergents, polyols and/or zwitterionic compounds are preferred.

The physiological buffer solution preferably has a pH of approx. 6.0-8.0, especially a pH of approx. 6.8-7.8, in particular a pH of approx. 7.4, and/or an osmolarity of approx. 200-400 milliosmol/liter, preferably of approx. 290-310 milliosmol/liter. The pH of the medicament is in general adjusted using a suitable organic or inorganic buffer, such as, for example, preferably using a phosphate buffer, tris buffer (tris (hydroxymethyl)aminomethane), HEPES buffer ([4-(2-hydroxyethyl)piperazino]ethanesulphonic acid) or MOPS buffer (3-morpholino-1-propanesulphonic acid). The choice of the respective buffer in general depends on the desired buffer molarity. Phosphate buffer is suitable, for example, for injection and infusion solutions.

The medicament can be administered in a conventional manner, e.g. by means of oral dosage forms, such as, for example, tablets or capsules, by means of the mucous membranes, for example the nose or the oral cavity, in the form of dispositories implanted under the skin, by means of injections, infusions or gels which contain the medicaments according to the invention. It is further possible to administer the medicament topically and locally in order to treat the particular joint disease as described above, if appropriate, in the form of liposome complexes. Furthermore, the treatment can be carried out by means of a transdermal therapeutic system (US), which makes possible a temporally controlled release of the medicaments. TTS are known for example, from EP 0 944 398 A1, EP 0 916 336 A1, EP 0 889 723 A1 or EP 0 852 493 A1.

Injection solutions are in general used if only relatively small amounts of a solution or suspension, for example about 1 to about 20 ml, are to be administered to the body. Infusion solutions are in general used if a larger amount of a solution or suspension, for example one or more litres, are to be administered. Since, in contrast to the infusion solution, only a few millilitres are administered in the case of injection solutions, small differences from the pH and from the osmotic pressure of the blood or the tissue fluid in the injection do not make themselves noticeable or only make themselves noticeable to an insignificant extent with respect to pain sensation. Dilution of the formulation according to the invention before use is therefore in general not necessary. In the case of the administration of relatively large amounts, however, the formulation according to the invention should be diluted briefly before administration to such an extent that an at least approximately isotonic solution is obtained. An example of an isotonic solution is a 0.9% strength sodium chloride solution. In the case of infusion, the dilution can be carried out, for example, using sterile water while the administration can be carried out, for example, via a so-called bypass.

According to one preferred embodiment of the different aspects of present invention, Cathepsin C, the derivative or fragment thereof can be used as an isolated molecule.

In the context of this invention, the term "isolated molecule", especially with respect to Cathepsin C, refers to Cathepsin C polynucleotides or polypeptides purified from natural sources as well as purified recombinant molecules (wherein the term purified comprises a partial purification as well as a complete purification).

The preparation of recombinant polypeptide or polynucleotide molecules and the purification of naturally occurring molecules from cells or tissue, as well as the preparation of cell- or tissue extracts is well known to the person of skill in the art (see e.g. also the standard literature listed below).

These comprise e.g. amplifying polynucleotides of desired length via the polymerase chain reaction (PCR) on the basis of the published genomic or coding polynucleotide sequences and the subsequent cloning of the produced polynucleotides in host cells (see e.g. standard literature listed below).

In the context of present invention, the term "polypeptide" refers to a molecule comprising amino acids bound to each other by peptide bonds containing at least 50 amino acids coupled to each other in a linear mode to form a polypeptide chain. Shorter molecules of this kind are referred to as peptides. The term "protein" refers to molecules comprising at least one polypeptide chain but can refer also to molecules comprising more than one polypeptide chains associated or bound to each other. Thus, the term "protein" comprises the term "polypeptide".

In the following, the invention is explained in more detail by means of examples without meaning to be limited by them.

EXAMPLES

Materials and Methods:
Mouse Strains Used:
Five different inbred mouse strains were used: AKR/J (AKR), CBA/J (CBA), C3H/HeJ (C3H), C57BL/6J (B6) and C58/J (C58). Mice were obtained from The Jackson Laboratory (Bar Harbor, Me., USA). For these mice strains it has been shown that they differ significantly concerning several in vivo measures of pain (Mogil et al 1999)

Total RNA Isolation:
Total RNA from DRGs (dorsal root ganglia) was isolated with the PicoPure™ RNA Isolation Kit (Arcturus) following the manufacturer's instructions. RNA quality was assessed using the 2100 Bioanalyzer and RNA 6000 Nano LabChip™ kit (Agilent).

Affymetrix GeneChip™ Microarrays:
First-strand cDNA synthesis was performed using 500 ng total RNA with a 100 pM T7-(dT)24 oligomer (GGCCAGT-GAATTGTAATACGACTCACTATAGGGAGGCGG-dT$_{24}$ SEQ ID NO:4) according to Baugh, L. R, Hill, A. A., Brown, E. L. and Hunter, C. P. (2001) Nucleic Acids Res. 29, e29 and SuperScript II Reverse Transcriptase following the manufacturer's instructions. Double-stranded cDNA was synthesized and then extracted using phenol-chloroform followed by an ethanol precipitation step. An in vitro transcription reaction was performed with the doublestranded cDNA sample using the BioArray High Yield RNA Transcription Labeling kit (Enzo) according to the manufacturer's instructions. Transcription reactions were incubated at 37° C. for 16 h. cRNA was purified using the RNeasy™ Mini kit (Qiagen) protocol for RNA cleanup and quantified by a spectrophotometer. The biotin-labeled cRNA was fragmented using a RNA fragmentation buffer (200 mM Tris-acetate, 500 mM KOAc, 150 mM MgOAc, pH 8.1). Hybridization and staining of Mouse Genome 430 2.0 GeneChips™ (Affymetrix) was performed according to the manufacturer's instructions. The microarrays were scanned using a GeneChip™ 3000 Scanner, and the scanned data were imported and analyzed using Resolver v5.1 expression data analysis software (Rosetta Biosoftware).

L5 Spinal Nerve Transection and Sham Surgical Procedures:
In anesthetized mice, the left L5 spinal nerve was exposed and the transverse process was then partially removed. After separation from the L4 spinal nerve, the L5 spinal nerve was transected. Sham surgery was identical to the L5 spinal nerve transection surgery, however, the L5 spinal nerve was not transected (see DeLeo et al. 2000).

Determination of Paw Withdrawal Threshold:
Paw withdrawal thresholds (PWTs) were assessed using a dynamic plantar aesthesiometer (see Szabo et al. 2005). After acclimation in a compartment with metal mesh floor, the stimulator was positioned under the animal's hindpaw, a straight metal filament driven by an electrodynamic actuator touched the plantar surface and exerted an increasing upward force until the animal removed the paw (paw withdrawal threshold, PWT). PWTs were assessed for hindpaws of the ipsilateral, operated side and of the contralateral side. Each animal was used at one occasion only. In all animal experiments the ethics guidelines for investigations in conscious animals were obeyed, and the procedures were approved by the local Ethics Committee Correlational Analysis:
For correlational analysis, the "pain phenotype" was defined for each nerve-transsected animal (Chung animal) as C1-S1, where C1=ln(ipsilateral PWT/contralateral PWT) and S1=mean$_{all\ sham\ animals\ within\ same\ strain}$ ln(ipsilateral PWT/contralateral PWT).

Two measures of differential transcriptional regulation were defined for each Chung animal and each measured gene based on its intensity expression data. The "raw intensity measure" was taken as the intensity measure computed by the Resolver expression data analysis software (v5.1) for the respective gene and animal. The "log ratio measure" was computed for a specific gene and Chung animal as ln(C2/S2), where C2=Chung expression intensity and S2=mean$_{all\ sham\ animals\ within\ same\ strain}$ Sham expression intensity.

Before correlations were computed, the set of genes was filtered to exclude genes that were expressed below noise level and without significant Chung vs. sham regulation. Eligible genes must be regulated in at least 60% of Chung animals with an absolute fold-change=>1.5 or in at least 20% of Chung animals with an absolute fold-change=>2.0. Also, corresponding gene expression had to be detectable ("present") in at least five animals as defined by a respective intensity p-value<0.001.

Pearson correlation coefficients for each gene between the pain phenotypic scores and one of the defined measures of transcriptional regulation were computed using the R software package (http://www.r-project.org/). Based on these, p-values of statistical significance and corresponding false-discovery rates (FDRs) were generated following the method of Storey et al. (2002). Genes with FDR<0.05 under "log ratio measure" or "intensity measure" were considered significantly correlated.

LEGEND TO THE FIGURES

FIG. 1: CathepsinC—Correlation Plot

FIG. 1 shows for every individual mouse its neuropathic pain phenotype (mechanical hypersensitivity, X-axis) and the corresponding gene regulation of Cathepsin C (log ratio (Chung vs. Sham control), Y-axis) in the L5 DRG. Mouse data are colour-coded depending on the used strain. A Pearson correlation analysis has been performed and revealed a significant positive correlation of the two parameters pain phenotype and Cathepsin C gene regulation. This means for individual mice that the higher the L5 DRG expression of Cathepsin C in Chung-operated neuropathic mice was, the more pronounced the mechanical hyperalgesia as exhibited in the behavioral test. This significant correlation indicates a causal relationship of Cathepsin C gene expression for the induction of the neuropathic pain phenotype.

FIG. 2: Cathepsin C—Intensity data

Absolute values of Cathepsin C expression in L5 ganglia of the individual mice of the strains AKR, CBA and C57 after chung or sham surgery.

FIG. 3: Fragment of mouse Cathepsin C mRNA, detected by the Affymetrix probe set 1416382_at (Mouse Genome 430 2.0 microarray) (SEQ ID NO. 7)

FIG. 4: Cathepsin C cDNA sequence according to NM_001814 (SEQ ID NO. 1)

FIG. 5: Cathepsin C protein sequence according to Swiss-Prot HUMAN_CATC P53634 (SEQ ID NO. 2)

FIG. 6: Primer set for Detection of human Cathepsin C cDNA according to SEQ ID NO. 1 (SEQ ID NOs 4 and 5).

FIG. 7: Probe for detecting mouse Cathepsin C cDNA (SEQ ID NO. 6).

REFERENCES

DeLeo J A et al (2000) Transgenic expression of TNF by astrocytes increases mechanical allodynia in a mouse neuropathy model. Neuroreport 11:599-602.

Storey J D. (2002) A direct approach to false discovery rates. Journal of the Royal Statistical Society, Series B, 64: 479-498.

Szabo A et al. (2005) Role of transient receptor potential vanilloid 1 receptors in adjuvant-induced chronic arthritis: in vivo study using gene-deficient mice. J. Pharmacol. Exp. Ther. 314:111-119.

Julius and Basbaum "Molecular mechanisms of nociception", Nature, volume 413, 13. September 2001, pp. 203-209;

Scholz and Woolf "Can we conquer pain", Nature neuroscience supplement, volume 5, November 2002, pp. 1062-1067;

Wood, J. D. "Pathobiology of Visceral Pain: Molecular Mechanisms and Therapeutic Implications II. genetic approaches to pain therapy", American Journal pf Physiological Gastrointestinal Liver Physiology, 2000, volume 278, G507-G512;

Woolf and Mannion "Neuropathic pain: aetiology, symptoms mechanisms, and management", The LANCET, volume 353, Jun. 5, 1999, pp. 1959-1964;

Woolf J. and Salter M. W. "Neuronal Plasticity: Increasing the Gain in Pain", Science, volume 288, Jun. 9, 2000, pp. 1765-1768;

Cigic, B.; Dahl, S. W.; Pain, R. H. "The residual pro-part of cathepsin C fulfills the criteria required for an intramolecular chaperone in folding and stabilizing the human proenzyme". Biochemistry 39: 12382-12390, 2000

Paris, A.; Strukelj, B.; Pungercar, J.; Renko, M.; Dolenc, I.; Turk, V.: "Molecular cloning and sequence analysis of human preprocathepsin C". FEBS Lett. 369: 326-330, 1995

Pham, C. T. N.; Armstrong, R. J.; Zimonjic, D. B.; Popescu, N. C.; Payan, D. G.; Ley, T. J. "Molecular cloning, chromosomal localization, and expression of murine dipeptidyl peptidase I" J. Biol. Chem. 272: 10695-10703, 1997.

Pham, C. T. N.; Ley, T. J.: "Dipeptidyl peptidase I is required for the processing and activation of granzymes A and B in vivo". Proc. Nat. Acad. Sci. 96: 8627-8632, 1999.

Rao, N. V.; Rao, G. V.; Hoidal, J. R.: "Human dipeptidyl-peptidase I". J. Biol. Chem. 272: 10260-10265, 1997.

Toomes, C.; James, J.; Wood, A. J.; Wu, C. L.; McCormick, D.; Lench, N.; Hewitt, C.; Moynihan, L.; Roberts, E.; Woods, C. G.; Markham, A.; Wong, M.; and 10 others: "Loss-of-function mutations in the cathepsin C gene result in periodontal disease and palmoplantar keratosis". Nature Genet. 23: 421-424, 1999.

Wolters, P. J.; Raymond, W. W.; Blount, J. L.; Caughey, G. H.:"Regulated expression, processing, and secretion of dog mast cell dipeptidyl peptidase I." J. Biol. Chem. 273: 15514-15520, 1998

Heusel, J. W., Wesselschmidt, R., Shresta, S., Russel, J & Ley, T. J. "Cytotoxic lymphocytes require granzyme B for the rapid induction of DNA fragmentation and apoptosis in allogeneic target cells", 1994, Cell 76, 977-987.

Manour, S., Thomas, K. R., and Capecchi, M. R., 1989, "disruption of the proto-oncogene Int-2 in mouse embryo-derived stem cells: a general strategy for targeting mutations so non-selectable genes", Nature 336, 348-352.

Soriano, P I, Montgomery, C., Geske, R., and Bradley, A., 1991, "Targeted disruption of the c-src proto-oncogene leads to osteopetrosis in mice", Cell 65, 693-702.

Turk, B., Turk, D., and Turk, V., Lysosomal cysteine proteases: more than scavengers. Biochim Biophys Acta. 2000 Mar. 7; 1477(1-2):98-111.

McGuire, M., J., Lipsky, P. E., and Thiele, D. L. (1993) J. Biol. Chem., 268, 2458-2467, Generation of active myeloid and lymphoid granule serine proteases requires processing by the granule thiol protease dipeptidyl peptidase I.

Henningsson, F., wolters, P., Chapman, H. A., Caughey, G. H., and Peijler, G., (2003), Biol., Chem. 384, 1527-1531, Mast cell cathepsins C and S control levels of carboxypeptidase A and the chymase, mouse mast cell protease 5.

Adkison, A. M., Raptis, S. Z., Kelley, D. G., and Pham, C. T. N., (2002), J. Clin. Invest. 109, 363-371, Dipeptidyl peptidase I activates neutrophil-derived serine proteases and regulates the development of acute experimental arthritis.

Wolters, P. J., Pham, C. T. N., Muilenburg, D. J., ley, T. J., and Caughey, G. H., (20019 j: Biol: Chem., 276, 18551-18556, Dipeptidyl peptidase I is essential for activation of mast cell chymases, but not tryptases, in mice.

Pham, C. T. N., Ivanovich, M. L., Raptis, S. Z., Zehnbauer, B., and Ley, T. J., (2004) J. Immunol., 173, 7277-7281, Papillon-Lefèvre syndrome: correlating the molecular, cellular, and clinical consequences of cathepsin C/dipeptidyl peptidase I deficiency in humans.

De Haar, S. F., Jansen, D. C., Schoenmaker, T., De Vree, H., Everts, V., and Beertsen, W. (2004) Hum. Mutat. 23, 524-524, Loss-of-function mutations in cathepsin C in two families with Papillon-Lefèvre syndrome are associated with deficiency of serine proteinases in PMNs.

Sheth, P. D., Pedersen, N M., Walls, A. F., and McEuen, A. R. (2003) Biochem., Pharmacol., 66, 2251-2262, Inhibition of dipeptidyl peptidase I in the human mast cell line HMC-1: blocked activation of tryptase, but not of the predominant chymotryptic activity.

Literature for Standard Laboratory Methods

If not indicated otherwise, standard laboratory methods were or can be performed according to the following standard literature:

Sambrook et al. (1989) Molecular Cloning: A Laboratory Manual. Second edition. Cold Spring Harbor Laboratory Press, Cold Spring Harbor, N.Y. 545 pp;

Current Protocols in Molecular Biology; regularly updated, e.g. Volume 2000; Wiley & Sons, Inc; Editors: Fred M. Ausubel, Roger Brent, Robert Eg. Kingston, David D. Moore, J. G. Seidman, John A. Smith, Kevin Struhl.

Current Protocols in Human Genetics; regularly uptdated; Wiley & Sons, Inc; Editors: Nicholas C. Dracopoli, Honathan L. Haines, Bruce R. Korf, Cynthia C. Morton, Christine E. Seidman, J. G. Seigman, Douglas R. Smith.

Current Protocols in Protein Science; regularly updated; Wiley & Sons, Inc; Editors: John E. Coligan, Ben M. Dunn, Hidde L. Ploegh, David W. Speicher, Paul T. Wingfield.

Molecular Biology of the Cell; third edition; Alberts, B., Bray, D., Lewis, J., Raff, M., Roberts, K., Watson, J. D.; Garland Publishing, Inc. New York & London, 1994;

Short Protocols in Molecular Biology, 5th edition, by Frederick M. Ansubel (Editor), Roger Brent (Editor), Robert E. Kingston (Editor), David D. Moore (Editor), J. G. Seidman (Editor), John A. Smith (Editor), Kevin Struhl (Editor), October 2002, John Wiley & Sons, Inc., New York;

Transgenic Animal Technology A Laboratory Handboook. C. A. Pinkert, editor; Academic Press Inc., San Diego, Calif., 1994 (ISBN: 0125571658)

Gene targeting: A Practical Approach, $2^{nd}$ Ed., Joyner A L, ed. 2000. IRL Press at Oxford University Press, New York;

Manipulating the Mouse Embryo: A Laboratory Manual. Nagy, A, Gertsenstein, M., Vintersten, K., Behringer, R., 2003, Cold Spring Harbor Press, New York;

Remington's Pharmaceutical Sciences, $17^{th}$ Edition, 1985 (for physiologically tolerable salts (anorganic or organic), see esp. p. 1418)

Standard Literature for Laboratory Methods:

If not indicated otherwise, laboratory methods were or can be performed according to standard methods listed in the below standard literature:

Sambrook et al. (1989) Molecular Cloning: A Laboratory Manual. Second edition. Cold Spring Harbor Laboratory Press, Cold Spring Harbor, N.Y. 545 pp or Current Protocols in Molecular Biology;

Current Protocols in Molecular Biology; regularly updated, e.g. Volume 2000; John Wiley & Sons, Inc; Editors: Fred M. Ausubel, Roger Brent, Robert Eg. Kingston, David D. Moore, J. G. Seidman, John A. Smith, Kevin Struhl.

Current Protocols in Human Genetics; regularly uptdated, e.g. Volume 2003; John Wiley & Sons, Inc; Editors: Nicholas C. Dracopoli, Honathan L. Haines, Bruce R. Korf, Cynthia C. Morton, Christine E. Seidman, J. G. Seigman, Douglas R. Smith.

Current Protocols in Protein Science; regularly updated, e.g. Volume 2003; John Wiley & Sons, Inc; Editors: John E. Coligan, Ben M. Dunn, Hidde L. Ploegh, David W. Speicher, Paul T. Wingfield.

Molecular Biology of the Cell; third edition; Alberts, B., Bray, D., Lewis, J., Raff, M., Roberts, K., Watson, J. D.; Garland Publishing, Inc. New York & London, 1994;

Gene Targeting: a practical approach (1995), Editor: A. L. Joyner, IRL Press

Remington's Pharmaceutical Sciences, Edition 17, 1985.

SEQUENCE LISTING (7 sequences)

SEQ ID NO: 1 - DNA, 1924 bp, Homo sapiens
cgtagctatttcaaggcgcgcgcctcgtggtggactcaccgctagcccgcagcgctcggcttcctggtaattcttcacctcttttctcagctccctgcagcatgggtgctgggccctccttgctgctcgccgccctcctgctgcttctctccggcgacggcgccgtgcgctgcgacacacctgccaactgcacctatcttgacctgctgggcacctgggtcttccaggtgggctccagcggttcccagcgcgatgtcaactgctcggttatgggaccacaagaaaaaaaagtagtggtgtaccttcagaagctggatacagcatatgatgaccttggcaattctggccatttcaccatcatttacaaccaaggctttgagattgtgttgaatgactacaagtggtttgccttttttaagtataaagaagagggcagcaaggtgaccacttactgcaacgagacaatgactgggtgggtgcatgatgtgttgggccggaactgggcttgtttcaccggaaagaaggtgggaactgcctctgagaatgtgtatgtcaacatagcacaccttaagaattctcaggaaaagtattctaataggctctacaagtatgatcacaactttgtgaaagctatcaatgccattcagaagtcttggactgcaactacatacatggaatatgagactcttaccctgggagatatgattaggagaagtggtggccacagtcgaaaaatcccaaggcccaaacctgcaccactgactgctgaaatacagcaaaagattttgcatttgccaacatcttgggactggagaaatgttcatggtatcaattttgtcagtcctgttcgaaaccaagcatcctgtggcagctgctactcatttgcttctatgggtatgctagaagcgagaatccgtatactaaccaacaattctcagaccccaatcctaagccctcaggaggttgtgtcttgtagccagtatgctcaaggctgtgaaggcggcttcccataccttattgcaggaaagtacgcccaagattttgggctggtggaagaagcttgcttcccctacacaggcactgattctccatgcaaaatgaaggaagactgctttcgttattactcctctgagtaccactatgtaggaggtttctatggaggctgcaatgaagccctgatgaagcttgagttggtccatcatgggcccatggcagttgcttttgaagtatatgatgacttcctccactacaaaaaggggatctaccaccacactggtctaagagaccctttcaacccctttgagctgactaatcatgctgttctgcttgtgggctatggcactgactcagcctctgggatggattactggattgttaaaaacagctggggcaccggctggggtgagaatggctacttccggatccgcagaggaactgatgagtgtgcaattgagagcatagcagtggcagccacaccaattcctaaattgtagggtatgccttccagtatttcataatgatctgcatcagttgtaaaggggaattggtatattcacagactgtagactttcagcagcaatctcagaagcttacaaatagatttccatgaagatatttgtcttcagaattaaaactgcccttaattttaatatacctttcaatcggccactggccatttttttctaagtattcaattaagtgggaattttctggaagatggtcagctatgaagtaatagagtttgcttaatcatttgtaattcaaacatgctatattttttaaaatcaatgtgaaaacatagacttatttttaaattgtaccaatcacaagaaaataatggcaataattatcaaaacttttaaaatagatgctcatatttttaaaataaagttttaaaaataactgcaaaaaaaaaaaaaaaaaa

SEQ ID NO: 2 - protein, 463 aa, Homo sapiens
MGAGPSLLLAALLLLLSGDGAVRCDTPANCTYLDLLGTWVFQVGSSGSQRDVNCSVMGPQEKKVVVYLQKLDTAYDDLGNSGHFTIIYNQGFEIVLNDYKWFAFFKYKEEGSKVTTYCNETMTGWVHDVLGRNWACFTGKKVGTASENVYVNTAHLKNSQEKYSNRLYKYDHNFVKAINAIQKSWTATTYMEYETLTLGDMIRRSGGHSRKIPRPKPAPLTAEIQQKILHLPTSWDWRNVHGINFVSPVRNQASCGSCYSFASMGMLEARIRILTNNSQTPILSPQEVVSCSQYAQGCEGGFPYLIAGKYAQDFGLVEEACFPYTGTDSPCKMKEDCFRYYSSEYHYVGGFYGGCNEALMKLELVHHGPMAVAFEVYDDFLHYKKGIYHHTGLRDPFNPFELTNHAVLLVGYGTDSASGMDYWIVKNSWGTGWGENGYFRIRRGTDECAIESIAVAATPIPKL

SEQ ID NO: 3 - DNA, 1782033 bp, Homo sapiens
  misc_feature (96336)..(96355): n is a, c, g, or t
  misc_feature (114130)..(117829): n is a, c, g, or t
  misc_feature (204711)..(204730): n is a, c, g, or t
  misc_feature (355690)..(356715): n is a, c, g, or t
  misc_feature (812139)..(812501): n is a, c, g, or t
  misc_feature (1726138)..(1726157): n is a, c, g, or t
  misc_feature (1779148)..(1779167): n is a, c, g, or t
ttggttaaatggttgagaaaacatggtaaatagacacaaaaactttttcatcttccaaaatcagagtcaaatactaaatgatcataaagtagctaatactgtctttctgcaaagtgaatctgagctaaattaaaagaatgtcaggaaataaatttttccttgaaaactaggaacaaataatgtaattaaattatgaggcattgactgctgcatagagttctagcatcaacagaaaagctcacaaaccataggagaaaatcaaaaaaaggagtgctgggttggagccctaaggtgaataattttatcatctcagatcgcttggaaaaaagcagcaagtccaaaagaagctggtgataagctttctctctgctaacccctaatgttctgcatgaaatgtgtgaaggcagaagagagacagtttattatagtctacatggtatagagtgaaggaataagagaacatttctgataagtgttttcaaaatttggagaatcattcctatctaaatcattcatttaagggactaaaatacaagtatgatgtttcttgccatctaaccctcagctagccaggctctaaaaaggacaacactggacacctcgacagtggtaaaaagcagggtttactcactcttgaatactaagaaatggtgctaaccttaggcagcagcttatctatttggttgaggttcagctttgtttcattgaacaaatctcttgggttattttcagttgtgccagtcatttaatttgttttctgaatcaaatgataagaataaatatggttttgagtgtaaacagcattcccagatatatcttacaacttggtgtgccatctgcctaattttgaacctataggatgggaataaatgcattgtgaaaaacaccaggtgatttccttaaagccaaatactcttgtccctcctacttttctcccggctttcctgctgcatgggacatggcaataaatgggagtttcctgcacacagaggtaaaattcactggttgaagatgtcagttttcttcttgaccaactcctatattggtacaaacatgtgagagaaatgcatcttctgaatcatttcaaatttgtggtctttgttagagcaggtaagccggtgccctaggagatgtagctattacattctattatagaattttccattctctatcatctggattcttatttaaagtgtaaactaattttgttctttctactgcataggaaggtttataccactttatgcttagcaagtaattaaatttatatgtcagtttaaggccagtctccactattctaagtcctgctcctctaccccatcatcttatataggaaccttcatctttcaaaggtttatattaaaaaacctaagacaattgaaatcaaccctataaaaattatgctacaattattttaaaccctaacataatagtattatctttgatatcaatctgaaaatcaatttatgtcttatcttttgatagatattcattagtatgttctatcctattttgttacgtacattttggaaaagtttctcaatgttagaataatatttatacatactaactcctctacttaatccatttattcatcttatttattgtataatctattctaaaaatcgcattcgataatggtaatatattagcaaagaagacaaatactgccattgcccccttggacttttcaatctggtagtaataagtataagagttttctgaatgttataatctgatataatatacttgagaagatgtaatagcagagcaacccagcactgaaaaacttttgtatgagctgaaatgagattaataactaggatgttgagaaataataaagtctgtgaggtcaacttaacttggtcagacttagaaagaaaataagcacacttctttattctttgtaagatgagatatccaccagttcatttttctaccccagcctggttcaaatatacaagtaagacaaatggtttacagtgtgcacaaactgaaaacatactctctgaaaaataaatcagattaaaaaaagaacttatgttgtatgattttatttacccgaatgcaaaaacataaaaagtagattaagtgttctgaaggaatgggggagggtgaatgcagaataaatgttaaggggtattgggattcttctggaagtgataaaagtgcccaggcagaagagagctctgatggctgctcaagtgtgatatactaacaatctctgaattaaatacattagaacatgactttcacagtaagtgaatgaatctcaaaaaacttgtacaaaaaaagccattattgatgttctagtaaagattccacaataatttattaattaaaataacttaattaatgaatgtatacattcaaggtggttatcccatttataaccataaagtaatcacattccatgaagttacagtgcgctcacaggctctcacacatagtgtcttaggacagtatttgccttatatatgggaggtcacaataaatcatcatgaaaccaacttttcatgtacaaccaaagcaaaagaaaggcctcagaggggacgagaaggaggaaggaggaaaaccatagataagagaacctttagaaacatcaaaaaaactcacagatccattatcataatccagaaacaccccaacccgacccagaggcctttgcacatactgaattaaaggtggagagttggtggagagactatagtgattgctcctctttgaggaaattaaaaaaaatctttcatcagaatcaataatgatattggtatctgctgttctggaatctcgacagactcccagaatccagttggaggagagggtcacatccacctcccagtaatgcttgccagaggtgaatgcttgtgctccccacacagcaaagctgtccactccctggggatccgtgggagcactgagatggtcatctccaaatatcacatatctcacatcctcagaaaggcttatatagcaaggagtcatttccgtactcagagcattatccactgacaaggaaaaaaatattatattagtgagtgttatgagggacagaggctctgtggcccaattattcacttcatttgctcttcttccaagaaaatacagaaaaaaggaagccaagagagttcagccccatgcatccatgaagatgaaatgttattacacctctacagcatatacaattatgtattattcttttaataatagagaaaaaatgtgaccatatcactgggcaaagtaatgatttaatgtctatctctgcacagtttgtttcagaacatatctaaaatgtatttttttcttcaatagaaaaatcttcttgtattatttgtctttaagatcatcaacaggtagacatcactttgctgtgatgtgagtatttattggaatgtaagttatgcctgctatagtctcaaacatcaaaaatttggtagaaattaacacatgtaaagtttataagtttctgaaaagaatattctggctttacattatctgtttagcccctgattcaatctactctgggttcctgctctctgctacctagatctgctctctagaatgggcctagcatggttaggtcatgttcacagatccctcaccttctgcttgttacgagatgtttctgatggcattagaattgtctggattatggatattttagtcattttctttgttgatcaaaatgttctgattttgtaaataataaaaattacttatagaatgcatgtaaatgcacatagaatagaaataattaaaaaccattatgccaaatctaagccttcaaaattgaattaaattgaataaacacgaaataccgatgccgccatgagaactagtgtcttcataactacatgacctgaatattctttgtcctcttattctgcagataaagtatgtatcttgctttacattttcgtcaaactgtaagtcaggaaattgagttttgatcattgtaatattactatgcaggtagggaagatgcacatgtttcggaaaactatgtattacctacatgtcaaaactaacaaaacttaaatgggaaaagcctcaaccaagggaaccaataaggaaataatttgaggctggaatgccaagcagctggctcttacctctgaagttgttgagcatgtctaggactccagttatgcaccatgaagtgagctctgggttcactggctggggcttttgcatctgtgccaaatcagtcctgcaaaaaaaatggcctcagttatatttccaggcccagagctaatcacacagtcatacaaagatatcacattttcatataagatgtttcctcagaattctgccagttttggttaactgggtatacactttattccacactctaggggcaataaggatgttactttttctaaattttacttgcataaaaacccagtttccccagatatgttattctcagacattatacaacttctaaagtcattaaaagtcattgcctccctctgcccatcacaccccttgagggtatgcagaaatcctggaaatatttcagagagcagaaaactcagacaaaaacctttgggacctcagcctgcagttgtcactaatgctagtcagtgtctaacagagaatgttcactgaggcaaaagtctttaatcttttgtgcaaaacaaaggagtctaattccagcctgagaaccttgctgctgaggggcccgaggtaaccattttcctgaggtctttcctagaactgggtgtatggtgatggaggaggcccgggtcattgatgcttttaggagcaaaatatccctcctcagcccttccttagggaatctctctcctccctctgtctttttttttttttttaacctcccacccctctagagtagaagacacctctatgattcctcagagtaattttgtattaagatctgtggggtatggttggtcaggatggatggattgggaaaccaaacttccgaatggcaaattgtttctatgtatattttaattcatacaaattgtaagatggaaactttccagaccaaagagaagaagacctcaggccctcttttgaaacaaaatcggaaataggcactgagaatgatgtcagtacctcaaaatgtatacatccccttcattcacaagagaacaaatttttcagaaatagcatttttttttagtgtaaactcaccttgccgatacatttcccacatgctgcaaaaaaatatatatataatgttaattatgagagatttttccttctgcatcttttctcatactcttgtttctttctgttttagtgttttaataatgtatatctttttatttccctctaaggaatcattcaaggctatgttaataacagaacctcaactaaacaatgaaaagcttcatcagtgggcattaagaagaaaggagctcagcaagagaagatggagtaaagcaaagatatctaggtttccagtgtcattaatttcctaaccttatttccaaggaaagctctgaccacacatgacaactattaaaacagagaaccatatgagaaacagagtacatggacattgatgagcagctttgacaaaccttgcccaggcaaggggaaacccctcaatgtcttcagcaaatcactgctgtgtgggacattagagagtgaggaggaactagggcatatacatggatattactaaccttcccctggcctagagttctaatgatcttagatgatctctcttgtggatagtactccaaattatattgaagagaactgtgttatatgttatctactaaattggcaaaaatttcccaaagattactaaagtatgcagtaataaatgactggaaaaatgtaatggtggaagtcagacagcatgtgtcacttagcttagagcagtgacatacgcaggtgatatttgcatgtcctggcagcgttgttcagcaaaggcttcctgtctctgaggatggaccctccctcctcacctggagcagctccacgtcaggcatgtggcatgtctcccacagctctctgtacatgtctttcatcctttctaaatgttgggtcattctcacttgactgtcttgtagttgttggaaaagctcttttgcttctctttccagtgcctgcagatgcagttgctcctcctcattgagaaatagatgcatcttttgatactgaatagtgattatcctcttccttaatgacacatagtcctgcagagatgtttggttaaaaggattacatattctcactctcaatagaaaacttcaaataattatatgcagcgtgtaattaagcaatttataaactttctgcctcactcttgcaaagagtcttgaatatttgctatctttttctgtccatctttttcaatgttcctattctctctccctttttaaatcaaacctatataaagactcctggtttccgtcactgtgacgcttcttcacagttcttactgggtcaattgtttcctctattaatctctcttttaggatttttccatgtctgcttcgcctacatgttaaaaaacatttagccatacaccatattatgcagtttttttttacttttactatatttttactctatatactattctatttctttcatcttcctcacacccaatcttagtgaaatgttgtctcatctgcagtgtctgaaaaggtttatgccaaccttcaaatttgaactagaatacacatcatgccgtttatccaatacactagaattaatttggctagcttgtgtgggcttctctgtttgcaattcctgttatatcaattgaaatcactacattttcttgagatgaaatcactatcttttaactggtagtttgaatttagctaaaaagtataagccaactttgtgtttatttgcgtaaaaacaaaggaaacattttcattcttaccactaatgaacaaaatttgctagtttcctgatttagattgtttcgtgtctcttgattgattttccataaatagtccatttcctttataagtttctcctgcaaaagaagcaagaagcttagcaatgatgaagacagtagatttcatccccttatcaataaaaaaaaaggctgtaattgaaagaaacataaattaagttagagtgaagcggtcagatttttccaagttaaacgaatatgattctaataatttggatgtgaaaaatgatagaaacataatagagagttttaagggacccttcagataatatcatcaattttctgagaaactggcttttacataacctgactttgaaaagtgttcttggtgctggccaccagctccacagctccattctatatgtttgaacaatgtttttaaggaaacctcctttagcgaagtctcaacacagctgtgattagagtgccaaattagccagcaacattgaaaggacacattcatgtgttatgattgacatggaataatcaccacctccatcatctgcattctcatcaccatcattatcacaggccctcatcattcttatttgggattctgtataattcaaactgccttagaggcatcacgtaccctgcattcctcagcagcccatcctattgggtgtggctgtgagccatgtgctctggtgactcagagcagggcccacagagcaatctcttgtcagcctcacagaagagctccttagtctccgcatggagcacacagatattgtctgagctgttgatgttctgaggtctggtctgtctggctagggaagacagctttttgagtaccacattggtgttgaagttgggcttctctgaggtttttctgcacgaagggcagcgcattggtgctctgccttcttctgagcagaggcagaggcagggcctgcaaaagctgtgcccacagtcaatggtgaccggtctatgaagtagttcacgcaaatgcagcaaatgagctcattctggaagactcgcagggcatcagaatccatgtttctgaaaattaaaaaaaaaaaagtgagaatttctttctcttatttttatttaccccgatgaaaaggaaaaaaaggccggtggacaattttctttgtctacttgagctctgtccaacatgtcgaataagttagctccagtacaaactgagacatagtaaatgcaaacatgctggatttataaagttttcgctcaatagccattgaagatttggttcaggactccctgacataccaagatcctaagatgttcaagtctcttattagtaagcggtgtgggatttgcatgtaacgtaaacctatcctcctgaatactttatctctagattactttgaatgcctaatacaatgtaaatgttgtataaatacttgtaatgccacactgtttaggaacagcaagaagattaaaaatatgtacaagtttggcagagtgcgttcactcatgcctgtaattccagcacttcgggaggccgaggcaggcggatcatgaggtcaggagatcaagatcatcctggctaatacggtgaaatctcgtttctactaaaaatacaaaaaattagcagggcgtggtggcacgtgcctgtagtcccagctatttgggaggctgaggcaggataatcacttgagcccaggaggtggaggttgcactgagctgagatcgtgccactgcactccagcatgggtaatagagtgagactctgtctcaaaaaaaagtacatgttcagtatacctgcttttttcttcctgtaaatatttttttatctgagattagttgaatccacgggtatgaaacatggatatgaacaaccatgattcaaatgataaaatgagacgagagtcctcatggcatttttgttaaacaagccgtgctctcagtcattcccagttacctagacaagcttaaagcctgggcggagggtaaaagctgggatgatttctgagtcacttatataagctaattgatgaagaagcacattctgaatgtcatcctgtctctgtcattctatctctctcaataattccatgatgataatatatgaaagacacttagtatctatggtattattctatactccctgcctccaaactcacctgtgaagtttgctcagacaattataaataaagtagcttttatctaagattgagtaatcagagtggaccgtcaactcctaaaattatcaaccattaaatttgtccttttaactttaatatcaaaactcttcctttcaatacattaaatgtaattaatatctattatttttaatttaggaaagttttttcccattgtcaattcagatgattagagagaacactttcacattctgaaatagccaatatttcaactataataattaacaagaattaatcaaccgttaattatcttctaaaataacaacaaaaaaagtgaagatatgtattaggttttccactctacactagaaaatccagaaatacagttaatggaagcatggccaccaattcacctttccccttagtgacttggaagttgtagcctctgggaagcccttgccagttggttaggtctattgatctattttctttctttctatcttttttttttttttggttgttgttgttgttgagatgcagtcttgctctgacttcaggctggagtgcagtggcacgatttcagcttactgcaacctcagcctcccaggttcgagcaactctcctgccgaggcctcccaagtagctggtattacaggcacccaccaccacgccaggatgatttttttgtatttttagtagagaccgggtttcaccatgttggccaggctggtgtctaactctagacctcaagcgatctgcctgccttggcctctcaaagtgctaggctgcaaacatgagccatcatgcccagccgattaaatctattttcaacagctttcacatctagtctgcaaactgcaaattttgaagagacagcaaataagacctttgcaacaagaattttcaaagtaattcaacatttttaacatttcctttggcgtacgttacaaccattactacatgcccacattctggtgaacattttaggtattttatgggttctatcattgcatgaaactatggaaatatatcttttcacacttaagaaaaatctaacaatacagaaaacagtcacatcaaaggaatcaaatagcaagggaacacaaaccataccttacaaattgaagatactttatattgattttctgtaaaatcactaagacagttacttgtttgcttagaaaagacccaagcatgctgccaggtaaatttaaagtattttgaagagaaaaagtgagcatgatgggtttactgcaaattttatactcacaaggctactatgaatggtctcagtctagaagctctgtagatatccagattagaagtcactcctggctcttcaaagcccagcagtcacaaatccagtgggtcctcactgaaggagggagaaatctctggacaagcatccttttaaagtgtatgggcccacggaagaccacacccacttcctgagatggattggattgcatagaaagggataaattggctgattaggtttataaagtattgaaaaccagacttgagggctcaaagctcaacagacaagtttggaatgagacgcaagaaagttgacttaacacagtttattcaaagcaatattttaagtagctgggcaaggaaggtggctcatgcctgtaatcccagcactgtgggaggcccacgagggtggatcacgaggtcaggagttcaagaccagcctggccaagacagtgaaactccatctgtactaaaaatacaaaaaattaaccgagttcggcggcaggcacttgtaatcctagctacttgggaggctgaggcatgagaatcacttgaacctgggaggcagaggttacactgagccgagatagcaccactgcactccagcctgggtgacagagcgagactctgtctcaaaagaaaaaaaaaaaagaaatattttaaatacaacaattatttcattaaatattatcacttgctaactttttttttcttttgagacggtatcttgctctgtcgcccaggctggagtgccagggcttggtcttagctcactgcaacctctgcatctccagttcaagtgattctcctgccccagctcccaagtagctgggattacaggcacctgccactaagcccagctaagtttgtatttttactagagacagggtttcaccatgttgcttaagctggtctcgaactcctcacttcaggtgatctgcccacctcggcctcccaaagtgctgggattacaagcgtgagccactgcaccgggccacatgctaactttaaaattttgtttctcactctgttttaaaattatagttgcttatgtgcctagccgttatttgtctgaatatgttcaaagataaaacattaactgggattaccaacacatccgtgctgtgtaactctgttgtttaaaaaagtatagcaaggaactcaattgtgtttcacataattgtatatataatggttgatagaattagttgtatcagcctgattttcttatagtctattttatggctattttatgtcttatagtctattttatgactatttcctaatgattgttttgtatgaaactaaaatctattttttattcatccacctttttgaataattttaaaagtgatactttacatatatatgtacataactataacaatgttatgtattcatattttaaaaattatataataattatttacacaataataataattattattactttttttttgagacgcagtctccctctgtcacccaggctggagtgcaatggcatgatctcagctcactgcaacctctgcctccgaggttcaagtgattctcctgcctcagcctcccgagtagctgggattacaggtgtctgccaccatgactggctaattttggtatttttagtagagataaggtttcactgagttggccaggctggactcgaactcctgacctcaggtgatctgctattatcattttagacttcaagtctttttcaaaccagtttttctgttccaaattggagactttttcttaagaaataattcaagaaatgaaaatactatgacaaaatatagaactttgtgacagttcttggacactttagcaatatatagctattactttcaaaaagattaatagaattcacaatattatcagaaatccatggagagcgtatgcttcagtgtaccagatagagcaatgggcacaaccaaggtgtcaattgttatgctactgtgagcagcagaacaatagcacaagggttccatctaatcatttcaacatggaagcaaacttcttattaggatttcttgctaatatcaaaatattcagctaaaaaaattttatttcctgggaaatgatataaaatatcaataagcatggtaaaatacactatcactatggaatgccataattagtgcatgagataaacacagggtttcacagaaagataaagtctttgaatgttcacaaagagattctcagattatttgaataatatttaataaacctagagttgacccttgaacaccatggtggttggggtgtcaagatcccatgtagtcagaaatcagcatataatgtttgtcttcctcaaaacttagctatcaatagcctactgttgactagaagccttaatgataatattcacagttgattaacgcatattttatatgttatgtgtatacagtatttttacaataaagttagctaaaggaaagaagatattaagaaaataaaaagaaaatatatttaatattcattaatggaaaactaaatataattagtggaagtggatcattataagggttttcagcctcatcattttcatgttgagtaatcagagaaggaggagaaagaggaggggttggtcttgctgtcccaggggtgtcagaagcagaagaaactccaattataagtgactcacagagttccaaccagtgttattcaagggtcaacagtaaatataggtcaaaagctttaaaactatattctccgattttctaaataaaattaaactacattacataaaaaaatttaataggaaatttcttggaatttcaggcaggtaaattggggcgggggtgctggaaactatatactagataaaccattgtactattggatttccacataattcacatatgtgattaacacttccataatgagagaggcagtgcttagagatgtagcagaaaaggtagcatagggtagttcaagatgggacctacatgcatggctgaagaatctgtatggatcatttactgattcaaacataaaatgaatactatgaagagaagagatgaaatgaaattacatatacattctgaaagaagtaaagatttcctgatggaaaagtaaaacaaataatattaaagacactcctaagcactaagaaagaaattggctctgtgtgaaagaaagagatatcatgagcttaattattgataagtcattctgattctttaaaggtgatatccttaaggatagtacttacaatacttttttcttcaaaatatcaagtgcctactgtgtcttaataaacattctaagccaatgcagaaatgaacaaatgagacggattttcttgcacctaaagagctaatgaggttgcagggtgagaaacacaagacaacaagtcaaaatacaacattgaaaaagtgaagctggcacagtggctgtggcctgtaataccagcacttcaggattctgaagtaggaggatcacttgtgcttagcagttcaagaccagcctcaccaacaaagtgagagctcttttctctaagaaaagaaacaaaattagcttgggttgtggcatgtccctgtattctcagacactggcttaggtgagaggattgcttgaacctgggaagtcaaggttgcattgagctggtattgcaccacgcttaagcctggatgacagaacaagaccctgtttcgaaaagaaaaaaaaaattgatagagtgacgcattgtgataagtgctttagagaaaaatacagcaggaaaggaaaataaagaatcatagacaaaaattgatttttgttttgttttgtttttgtttttgtttttgagacagagtctcgctctgtcacccaggctggagtgcagtggcgcaatcttggctcactgcaagctccgcctcccgggttcacgccattctcctgcctcagcctcccaagtagctgggactacaggcgctcgccaccacgcccagctaattttttttttttttgtattattagtagagacagggtttcaccgtgttagccaggatggtctcaatctcctgacgtcgtgatccgcccacctcgacctcccaaagtgctgggattacaggcgtgagccaccgtgcctggcccaaaattgaatttttaatactatggtcagaaaagacatagtatagaatatatttgggcagatacctaaaggaggctagaaacgaaggtgcgtggctatttcatgtatttcagctttttcctagctttttaggaagcgataactacattaaaaatatctaaatataaactgattatttctccacaccatatttgcccccattgtctattatgaagcttctgatataaaggagaaagaatgagaatacagaaaattgaagccagatctcaaggttgagagtaacttatttatgatcaataaagtctcacaatatgtacggtaatttaagcatggtaggtgagtgttattccgtgtgaaatgaatcaaaatcttactcagaatactgaaggtaaatatgtcaagtgtatatggagaccagagacaagtgctctgctgcctttggcacagagcacaagcaacacttttaagcttcattacttgtttctcagtatcagaggaggggagaatgtctgcctattgacctcgacggcatcctcctgcaactaatcatccctcattctccttgtccctgaactcccttgacccaccccctccttcatttgattggctctgtgtacttgttagaatcagaagatctgggggaactgtggcttctaaacatgtacactggactctacccatatccagccctgtgaccctacaaacgtgctcaactgaattttcctcccatagagacactcttcctgctgagtttctctcctgtgctcctagagccaaatggcatctcgtgtcctgtccctggatggcttaacccaggaaaactcctggatccaagaggagtcagacaaaggaatggtggccttgtgcgtgctgatattctcacagatgtaaaggggatatcctgaaatctagggtttcttccttcccttttccctcccttacagcttctgctgctcctgggacctttgctctatctctcatccagctcagactgttgctgggcctgagagtctttgcatagccaaggtggttctcgaagaactcttgtctgcacgaggtctgagttgcttctccagaatctgtagcatgggtttccataactgcaggaagatctagagctactggtaactaggcagagaatgttctcatgtgtctaacatggcatgacactcctctccatgagcggtagaataaatgcattcagatgaagccctgccatcattactttgtcagaaatagattctgtcaataggtcttactggtataagtgtaagagatgagaatacattttaaaagtgttgcagtgatagtatgtggtaattctaaagttttcaaaacctaaagagcagatgggcagaataacaacttgtttgtttctttgattctttgtttgtttgttttgagacagagtcttctgtcaaccaggctgaagtccagtggcccaatctcagctcactgcaacttctgcctccttagttcaagctattctcctgcctcatcctccctagtagctgggactaaaagcatgcaccaccacacctggctaatttttttgtatttttagtagggatggggatttgccatgttgtccaggctagtctggaaatcctgacctcaggtgatccacccaccttggcctcccaaagtggtgggattacaggtgtgagccacctcacccaacaagaataacaactttctaaaggagtcgttttctctctctctctctctacaggatttgggagacatggtggcaaggtatgttaatggccatcagtgcaagctggagcacaaggcgtgctgtgaaaaacatcaagttgtttccaacaaagggaaaacataatttactaacaccataatgtgtcaatgtgattgtgtgtgtaagtgtgtgtacttatgtgtttgtgtggtatgttgaatgttacctatgcctcttatcagacattaaacttttcttacttttccaagtgactcaggggtttctgttttgaagagttcaatgcagaagttgctagaatacaattgcctctttttaggattcagaatcataattagagatcaactatttggtggcagatagggagagaggcatttatctttcagtggcagtaggttagaaacggagtgaagagttagaaagattccctaagggccacaaacccatcctaggattgtggaggtacattacaatatcagaagtggtttgaatgaagcattttctgttggaatctatttcttaaacacaaacatcagaaacttaaccaactcaacctacttccttgcaggagtgagtccgtgctgctgcacatgccccagcctgtgaatccagagttccctacagggcccatcacaggaccggtggacaggctcaaccacttccgaggtgagtgtggccctcttggtgggatcaacatgcaatgccttcagttatggttttctatgggcagccttcccagtgtaacgatttttcatctagaacaagagaatagtctgtgaataggtatttatatttatagtttcactatcctcaaacagacaaaactaaataaaagatggtggaatcagccatataacaaatttcttggaaaagtaaaacacgcagaagggctttttaggacgtagaaccattcatgtatggttcaatcgtgatacaatttcatgtatacaattattacatgaagtatacagaactgaattaattcaggacgtttcaatttcaaattcagtgcagttaatgactgatttgagtgacagtgtttttttaaatacatttcaggtgaagtttcatagcatttataattttaatcacgtgcattttaatcaactaaagcatacatgagtaacttatataacaatgcaaacactgagaatctgtgaacaataagaaagtgatttggtggttgatgaggccttagatagaactccaggatagatcatgataaatccagcagataaaagatgtctgtgcctgaatctggcatgaaagtcagataattctggcaaggaatctgcacttttcagaaggcagattcagattttctctttaagtatgaattttctagtttaagtggcagattataatatttctggaaagcgataacttttttatttgggtctaagaatggctccccacctcatctcctgtccccagcctcctgctctgccctgacagagaagaggcaatggaggttaattttattgctatggacttggctgcagtgcaagaggttccagtttttcagttgttatgaaaggtcgctaactagacatagacatgaccttcctcccctttatactttttgagtttatagaaattgcgatcattgaagttgagccatttacttgtgcagatatcctaacaccctttgattccaacatttttccaggcagaagttactttgtaatcttgacctgtgttttctagtgagaatctctttcttatctgaacataagaatttataaactgcttttcactggaacgttctcttttttctacagtggaaatttccttcacttgggaaggaaccaattacaatatcgggctgtttgaggatgtgagaagtttgatgtttagacgtggatctttgaattctgacagatctgactattttgctgcatggggagcctgggtcttctcctctggcaaacactactgggagctggatgtggacaactcttgggactgggctctgggagtctgtaaggactcctggataaggaagaatagcacaatgtttaactctaaggacatatttcttcttttatgtgtgaaggtggataatcatttcagtctcttgaccacctccccaatgtttcctcactatgtagagaaacctctggtccgagttggtgtgtttcttaattttgaaagtggaagtgtgagttttttgaatgtcaccaagaattccctcatatggaattacccagctggctccttaaattttcctgtcaggtctttcttttacactggccacagatgacaaggattaagaaacctgactgttcgggaactccatatacaggggagccagcccttcactgttgatacaaagaaatcatacttttcaggcttttttctactttagtgtcacttcattttattgctattaagtagaagatatgtaaaatgcaaaacatttttgtacattttcttacaattaaaataatctcttatggcccattacctaaaatatgtattgtgattttcaagtgtttgtgaatttattggatggaattctggaaatatgtgggtgtgtgattcccacttaattatcccatgcaggaacaaaatttgcacatcatggacagacaggattttgtacaatgcacttgtaagtgtgagtgctctctcctattaatacggtaaattctacacctcattgctttaggtggaaaaatttattttacacagaagttttcactgaatctttgggccagaataggaatttaacagtcgtgcatcctatggcaacaaaaacacattctgagaaatgcattactaggcgattttatcattgtgtgaacattagaacacacataaaaacctagatagaatatccatctacagatataagctaaatggtacagcctattgcttctctgagaagttgctagcaatgtctcagcaggaaccaaaagggtttaacccacattgaattctgtagctgtttaataaagcaaacagcatcatccagggaaaaataaacagatgagcagactgtctactttaaaatgtgtttatgcttcccattcacacggattgtgaattctcattgttaacctagagtcccagctagtcaggaggctgaggcaggagaaaagtgtgaacctgggaggcagaggctgcagtgagctgagatcgtgccactgcactccagtctggtgacacgatgagactccatctcaaaaaaaaaaaaaaaaaaaaaaaaaaattaacttcaaattccaaaacacttaatgttgcaccctccttgaacaataactaaaaaaactcatttccactctgtgaaaatacaatctttgagcttataactggtatcagcagatcaatataaaaaatacagtaccaagctacactggtatatttccattttaagaactccacaatatcctcattgctgagagcatagtccttgcattagttttcagtatgctatgaacaattatctgctgcatgtaaacatgtctaaataactatagataaaatacatcaatcataaatttctgtaaaagataataaaatatcttctttaaaaaacaaaacaataagctattactgcattatttccaattttatgaaaatggaacaaatatatggttgttgctagtcttgagttcattgcaataaaaatggccctagttcctggttaaagtcagcaatcaatctattttcttcaatagatgtcttctagttgtgtaggcaagaatttgttttacatgctattctgtcagtttataaaattatacaccagaaactgaccagtaccacagtactctgttgcaaacagttttccatcaggagtgggatctgagaaagcaatttcttctttactcaaatatgagatatatataaagttactccttaggcattcaatcatgcgagaagcaattttcttccaacacatcatgctgaatacccatattcgactgatcccacagattgcaggctctggtaacgttgagcagcaagattccaattttaaataaatgggaggctatgtttttctcacctacttatacaaattgaggaggtaatcaaaacgaagattgacactttcatcaactggatttcctctgtacgtgcaagaaagtgcaatctgttgccatctcctgttcagtgagaaagctgaaaaaacatcctgagcaagaggacctgaatgtaaggaaatgacctggtgttttcctcagtacttctgttcccatcctattgcttcaagcttaggtatacagcacactgaactgcaagatgtatccggaaatgctgaatacacactaaaatgtttatttttatttcctttattttattttatttttatttcttttgctagagacaaggtctcgctatattgcccatggtggtctcgaactcctgacctcaagcaactctcccgcctgaactgcccaaagcactaggattagaggcatgtgccacggtgtctggtcttttctttttttggtctcaaactcctgacctcaagcaacccaccctcctcaactgcccaaagcactgggattagaggcatgtgccaccggtgtctggccttttctttctttttctttttttctttgatttagaagagaaagaaaattaaatgacagcacagcagaagaaatgcccaagagcttgtgttcaatgaaaatcaggtgatcctttactgaagagttgcttttagttagaactgggaatgggtattcaggaataagtaaactctgcttttcaccactgtcgaagtgtccagtgtttccccattcagcaactggctaattaagggtcatatggcaagaaggatcttatgtgtcttttaatctcttaaactgatcactaactcaaggtgattatacaaattatgaaaatgcttattagcaatgcttccttattctttctgtctgtactacctacactccttagttaactttctctcttctcctcccacacacttatttgcagcactttcctaggtaacaggaaaagtctatcaccttctgatgatttgtgtctctccaactgatctcagattatagaattttgccttctgggctttcaacccaattctcctttttatttccacctaaagtttctgagctttctctactgacactaaaaatttccataagcaacagctattacactctcaatattaccttgttaccaattttgtttgtcacttattcaaagaaaattttatagctaatcatatttagcttagatttacttgtacatacagttggtattagctactgtagacatttaagatattactttaattttggaagaggggaaagtgcgtattagtttggtaaattttcttagccattaaaccaaaaacttgttacattcctctgttttgataacttctattagaattattatcatctgggacattcctaaaattgagaaataaaattaaggtgcaactactgggaaccttgccacttatatcagaaatctaggactcctcacctcctgaagaggttattgatccatttgccttgtcgcattttgggggacacaagttaaattcttcacagaaataaaattcaaagttaaaaactgatgtggagacatagtatgtgtgtagttcaaaccagagagatgagatgaaattgtaaaaggaagagtatacaaaatgagaagagatcatgttctgtgatgaaattgtgggaaagcaatagcataaaggtatcactgaggaacttgagaccaggaagaaactaagatgtgtttacccatgtagttaaaaaaagaaaattacatgttgggaggctgaggcgggcagataacttgaggtcaggagtttaagacaagcctggccaacatggtgaaagcctgtctctaccaaaattacaaaaattatccagacatggtgatgggcacctgtaatcccagctagttgagacactgaggcaggagacttgcttgaacccagaaggtgcaggctgcagtgagctgagattgtgctactgcacttcaccctgggtgacagagtgagactccatctcaaaaaaaaaaagagagtgccagacatggtcacttatgcctgtaatcccagcactttgggaggccgaggtgggcgattcatgaggtcaggagtttgagaccagcctgaccaagatgatgaaagcccgtctctactaaaaatacaaaaattagctgggcatggtgcatgcctgtaatcccagccactcgggaggctgaggcaggagaattgcttgaacccgggaggcagaggttgcagtgagctgagatcgcgccactgcactccagcctgggtgacagagcaagagtatgtctcaaaaaaaaaaaaaaaaaaaaaaaaaaaaaaaaaaaagaaaagaaaaagaaagaaagaaaagaaaaaaattgtgtgtggcaaaataaagctagtaagagttatttgttctaaagaaaagcagcaggagtatctcagattagtattgaaaagcaaggataccataaggaagagtttagactatgataggagcttcactcgaatgctgagttataaaaactggtcaggtagtggtgtgcaagatgttctataggcagaaagaggcaacagctaagagattaaaataatttccatcgaaaggagccttgactgtcagtataggatacaagtaacagagagatagaagtaaaaacagtataaagaacatctctagccaaatatttcaggtattaccatctaatccctcaaaaatacttatctaggccgggcgtggcagctcacgcctgtaatcccagcactttgagaggttgagagcagtggatcacctgaggtcagcagtaagaccagcctggccaacatagcgaaaccccatctctactaaaaacacaaacgttagcctgtaatcccagctactcgggaggctgaggcaggagaatcacttgaatccgggaggcagaggttgcagtgagctgaggttgagccagtgcactccagcctggcaacagagtgagactccacctcaaaaaaaaaaaaaaatatctaatgtgtctaatgtgttcccattttctctaagccacagttttctgaggtgtggaaaaagaaacatgactaaaattccacatggaattgtcttcattgagtaaaattccttggcatatttagttttgaagctgtacatttgagtaggtgactatgaagtaatgacaacagtaacaacaagttgatagtattcctacatacaggaagcagcattttgcctttgtggaaatagaagaggcatttgcacagagaagggccaagcaccatctgatgagagatgggcaccaagattggaaatggttagggggaaagatatgaatagcaatagataataatcacatttaatttaatttatttaccaaccccacccaattcagtgaggtgtacttgtatgcaagatattgttttgtgattcttattgttgaaatcaaagaaagtgaatgattttgtatgtgaatttatgagaactggagcagttgcagctaacttgagtttgtaaaaatatccagaagctgaactgattctgttaaagcatgaggtcatattggagaggtccctagactctgtatacaatctggatggatgcttttgaaccacattttgtatttcttgaaaagcagagttgccttaattaacatcagaggatctgaagatatctgttctgctttttgtcctgtgtgagatactgtggagtgaagtgaagcaaggaacagagaaagaccacagccatcagctaccatgataagtagcagacctgaaaacaaaattctcatgtatacagggcacagggctggtactcaacaatgaaatactagctaatactgagtgcctaatttgcaagaagaagatcaacacacaaagaaagagcctttttactaagcattagaagttatgacagaaataaaatatttttctagaaatgatgagacagaagcttatcaccaaaattactcatgcagggtatattgccataataactaactaatgcatcttttacctgttgggaagagttttcttaggacttcttaattttcttaggactagcgccagaataaagcaaaaacatctggatgagattgaataaaaattcctttcaaggccaagcatagagccttatgcctttaatctcagcactttgggaggctgggcgggaggaatgcttgaatccaggagttcaagatgagcctggacaacattgagataagctatttcttttcttttctttttctttttttttttttttttttttgagacggagtcttgctctgtcgcacaggctggagtgcagtggcaagatctgggctcacttcaacctctgcctccagggttcaagcaattctcatgcctcagccttttgagcagctggaattaaaggcacgtgctaagatgcccagctacttttttttttttccatatttttagtagagatggtgtttcaccatgttgcccaggttggtctcaaactccaggcctcaagtgatccacctgcctcagcctcccaaagtgctgggattacaggcatgagccactgggtctggccccagatactctatttctataaaactaatttttcaaaaaattagcagcatcatggcacacgtctatggttgcagctacttgggaggctgaggtgggatgatcacttgaaccttggattttgaagctgcagtgagccatgactgttccactgcatcccattctgggcaacagaactagagcttttctcaaaacaaacaaacaaaaaggtattttatttcaccacaatgttttatttgcatatatttgcttgtgcacatatatgtgtgtgttgtggtgtagagtagaagacgagtttaaagtcacgacatgggtgacagtttgagcttatatcctcaaactctagcatgtgtcagaattatccacagggcttattattatagatattcctaaaccccaccatataaaactaattgtaactacaatgtcgaaataattatttatgtgagtaatataagagatacatgtctgagagtatattcttacaggagtaaaggtttctttttcagtagaagtttactctcattaacaaccataaaatataaagaaaaagatgataatttttaaaaataatatcagcaagtttttaccattaaaatcaccaaggagtttaatccttctaatatttttctatacttgtttttgtctatatccatctttgtctataatttttaaaaattttttcaaaataagttatatttattgtattttaaagctaaaaatgtatttaaacattttattaatttaggctttttcaaataatatcttgttatttgatacgttcagttaattactagttggtaactttagatataaaatgtttgaaaggcagaaacctgttttataaattatgaagcctcatattgtcaaaccctaatttgatcaatgcacaatttatacatgtatcaaaatactatattgtaccttataaaaatatgtgcaatttttatatattgattaaaaataaaaattttaaaatttgttcaaataagttgtcatttaaataaaggtatctttttgattagtttgaatttgatcaaaaacaaaattatctgaatttttttgagaggcagtacctatttcatttccctaaatttaaaattaaatcagccagagatgccagacaccgagcttctacttctctttttccaaaaccacccaccatcatcattagcattttgatctccaagtctaaaggctggtaggaattgatcagtactgaagggaattacatgtccaggaggaaggtgagatggtagcagatcccagatttcagtgaagaaagggcagaaattatcaaagaatggaatggtgtatattcaaatatcatataaaaatactgtcagatgtgggaacagaaatgaaagtagactcgttgccccagaaaaatcagacatgaattttccacctgggtgttatttaaaaatcaatgacaatataaaccagcactagagggtgtttgtagagggttatttacagagattagaaatggagttaatttaatcaacggttgaaaggtaaatccttttattgatactttgtactgcagacatctaatcagggaggggctttaaggatcctataatacactggcatccaaaaagcaagtctaattattttagaggcatttggaatttgctagactgtggaaacctcagaaaataacatctgttgtccagaaagcccagaggacacagaactcctgagccaaatgcatgaactttcctgcaagcactgttcagaccagttatagaatattcaggtgagtatttcctttaattttttgttccttgtttatacaaattgtgaacttctggagggaaagtcctagatattatacagttttatctatagcatgatatctagaatttaattggaaacctttattgtagaatatgaaaagttccatgttgtctttaacttcaggttgaatgcagccttggtcgtctgcaaagtttttaagtgctcaaaggcacttttttattttcctaatattccactgaagtttttatttctgtcatggtatttttattttacaaatctattttgttgtttgaatcctctttttaaagcctcttgttattttttgatatttttattatatttaatatagtttgataataaatatcatacatatgactttgtgaagctactatataaatgtttattttattttattttatttttattttccttttttgagatgcagtctcactctgtcaccaggctggaatgcagtggcgtgatctcggctcactgcaacctctgcctcccaggttcaagcgattctcctgcctcagcctcccgagtagctgggactacaggggtgcaccaccatgcccagctaatttttgtatttttagtagagatggggtttcaccatgtcagccaggatggtcttgatcttttgacctcgtgatctgcctgcctcagcctccaaagtgctgggattacaggcgtgaggctctgcgcctggccaaatatttatcttttatgttacaaaaatttaaaaaattaacaattcatacagcttcataaagtcacaggagttcatacattttgtttaagatcaaaacttactctcaaatggttcaggaataaaatgtcttaaacttctaagtatttcgtaagtgattgtgataaaaaatgaaaaataaaaattagatggattatgacacagaaaagggaaaatcacacaacattgacaaggtcaatttttttgagacagagagtctcactctgttgcctagtctgaagtgcagtgatacaatcaaggctcactgaagtcttgacctcctgtgctcaagccatcctctcacctcagcctccagagtagttgggactacaggcactacaagtgtgggcctggctaaatttttgtttttgtagacatggggtctctccatgttgcccaggctggtctggaactcctgaactcaagcaatcttcctgcttcagcctccaaaaatgttcaaattacaggcatgagccactgtgcctggccctatataaattcttagttttcccagtttcttttctttctttctttctttctttctttctttctttctttctttctttctttctttctttctttcttccttccttccttccttccttccttccttccttccttccttcctttctttttctttctttctttctttctttctttctttctttctttctttctttctctttcattctttttctttctttctttatttttctttctttctgtctttctttcttgtttttgttttttgttttttttttgacaggggtctctcactttgttgcccaggcttgtctcaaactcctgagttcaaacgaccctccttttggatcttaggctccaaaagtgctgggattacaggcatgagtcaccatgcctggtcacagtttcatcatatatgtaacggaacagcaagcataaaatgagctcacagagttttaaggagaaaaataagatattaataataaatgtaaaacatttgcatattaggttcctggggctgctgtaataaactatcacagataaaacaataatttgctctctcacatttctgaatgcctaacatttaaaatcaacatgttgatagagtggttccctttggaaattctgaggggaaatccacctcctgcctctctgctagcttctggtgggtgatgggaatccttggctttcattggcttgtggcagcatagctctagtgagctctgtctctgcctctgtctccacgtggctgtctatgtgtctcagatcttccttttattttttctctaaggataccagtcattggacttaggtcccaccctaaacccagactaatcttgttgggagattaccaaggtagttacatctgcaaagatcctattttcaaaagtccatattcacaggtttcagtggttaggacttagacatatatttcggggggccactctttaactggcaatttgaaaaaaatgcctggctcagaaaacagccccataacaacaaaaacacaactgtatttttatttccactgctttacgcacatcaccctaacttttacaattgggaagatggtacttcttttttcctaaattcagattctgaatatttcacacctcttttctaatgtcaattctatgttttttcccttttttctgagttagaatacatcttgtatttatttatttttattatttataatcaccacaatatatttgggagtctgacattttttatttctgaaccatttgagactatgttctgatcttaaacacaaagtatggaatccattattttttcttttttttaactttcatttgtgaaagttacttttttcttaattactctttttatttgttacattactaagtttgttttattttaattttcaaaggacattgatgaaatgacttttttatgatttttgagatgaaaaatttaataactttaaattttacattcttttaagtttttcacagtttattttaatgcttttttttgtaaattttaattatagttatttatatcttcatttattatggaacaacttcccaaaagtctttttcacataataaatttaatataatatataagctattatttattttctcttctgtctcaaatatggactttaattatattccaatatttcagaacattttaatctatgttttgagacatttgtgacttacgtgatattatgactattattctttacacttctagtgaatttttaatgtcattcaaaggctacatccttctatactctactgagaattaaaaatagttctcaaaaatattattctcagatattcagaactcattctcagaatttcaacttccaccagtatcttaactctgttctctttcccttctaatgcacattttccccctcaaggcccattgttacactccttattcaccctccatttaagattcggttttatttaatgttgtatgtatttgtacacaattttatttatgtgaggcttagtcttagaatagaagattatcctaaaaagactagtgaaagagttatgagaatttcaagagtgaatccagaaatcacgtaccagaagaattacttcaggcaagacaaaattgctaaaaaaaaaaaaaaaaaaggagtagtcatcagatctgccacattttcaagttctgtaatggaaaatggtaggtattctggagggagtttctggaggaagccaaactttcactgaggcttaaatatgatgaacaattaaccaaataaagttgaaatgttttataattgtcattaaatccttgatatttaaaaggagaagcagtatggttcttagaaagcattcattcccggcccaggagtggtggctcacgcctgtaatcctagcgctctgggaagccgaggcaggcggatcacctgaggttgggaattcgagaccagcctggccaacatggtgaaaccccatctctactaaaaaatacagaaaaattagccagtcgtggtggcacatgcctgtaatctcagctgcttgggaggctgaggcaggagaatcacttgaagccgaaaaacagaggttgcagtgagcccagattgccccactgcactctaacccgggcgacaagagtgaaactctgtctcaattaaaaaaaaaaaaaaaaagaaataaaagaaagaaagcaagaaagcattaattcccatgcactggtcctggagaatctataattcagtcttttatcacaggttcacattcccttataaaaaggtaacagttggatgcatgtctggaggagctcttgggcttgtcctattgtatctttaacttctcatctgcacctttagctatggctatttgggctgtgcttagataatggccatactcagggcactgtagaatgaacagtccttcctgtttaggcatttctccttccactttaacttctgactctgtcttcagggcatatctgttatattaagcttcttaagtgatgagcggtctggtgtttgtgttatgcaactcaatttaagataggttcatgtgagatctggcagaaagcaggctggggtggggtgtggagatactgaatattgtgcatgtagcatatgaaaggcaaacatacatttaattcagaaacaggcaatgtttatttatagttaagggtcaaatgaattatacaagggacatatgacaaataggatgtaatttgcttcattaatccaaatgaaggagagtaactttctttctcctcagaaatacagaatcacatatactgcaatacttccagaaataaatcatccactgagtcttaaaagtaaagaactctgtgttcttgctctggtgtctacataaccgggatcttataagtaagccaaagacatctaaatggctttgcctagaagccaaggccattggtccaacaaagacatcttgaggttactggaatgcatggagaataatcgcccatctgatgacaacagcacgtttagctcaactcagtcatacatggactggggaaaagtagcttttaaaaacttttctggtgaaatgtgcagactcaaatggttagagatttcttgcaacttgagaaaattcggcactttgaaagaattagtcctggaagctaagaaatgtgttaaaaagatgaacaaaagccaaaaatacaggaactgtccagactttccaaaaaggccccttactgcttataatcgcttcttcaaggagagttggccccagtactcccaaatgtaccctgggatgagaagccaggaactgaccaaaatcctgtcaaagaaatacagggaactcccagagcagatgaaacagaaatatattcaggatttccagaaggaaaagcaagaatttgaggaaaaacttgctcgattcagggaagaacaccctgatttagtccagaaggccaagaaatctagtgtctccaagaggactcaaaacaaagtgcaaaagaagtttcagaaaaatattgaagaagtgaggtctcttccaaaaacggatcgatttttcaagaaggtaaaatttcatggagagcctcagaaaccccccatgaatggataccacaagtttcaccaagattcctggtcaagtaaagagctgcaacatttgtcagtgagggagcgcatggtagagattggcagacgctggcagcgcatcccgcagagccagaaggatcattttaagagccaggctgaggaactgcagaagcaatacaaggtgaaattggatctctggctcaagactttgtcacctgaaaattatgctgcatacaaagaatcgacctatgctaagggtaagaatatggccatgacaggaggcccggaccccaggttgaaacaagcagatccacagtcctcatcagcaaagggtctgcaagaagggtttggggaggggcaagggctccaggctgcaggaacagattcatcacagactatttgggtaaactgtcatgtctccatggaaccagaagagaacaggaagaaagatagagaaaaggaagaaagcagtaactcttcagactgcagcagtggagaagaaatagaagttgatgtctgagggcagtggctctagtgcagcttccttgtttttttttttttgtttgtttgttttcttttcttccttcctcccgcaaagtaggacaggttgggaagaaagaagcaacttggtgcagcactctcctacatcaagattatgaacctgggaggaactctttgggaagaataaatataagtttgagccactactggccttatccttaaaaaaacaaacaaacaaatatcatccctttcccgaggaactttatgcaattaaggcttctgaaatgaagagatgattacgttgtggggtacacactgtattagactgaatatttctgaagcaagaagctttgctttactcatttttgtcctgccaaaggtggtagggggatacccataagcctgggacccaaacttccctttggaaatgtttttcaggactcctgcaccaaatctaaggtcggggatatttgatgaaaggtggggtaggtgtcttaagagaattgtcccactcttgatatctctctcctcccctccctgaagtaaggagttggccattcccatgcctgggagtagggagtaatatttctacatgtatatctgactcagttctcaattagacttttcttgcttatttcaaaaaaaaatgaaaatacaaaataaaaagttactgatttaatctgaaagagctcctccacagaatcatttgtgacactgggtgcagcttctctaagttatatcttcatttattcttgaagctccaaatttttcctgctgcttcagatgcaagtgaatctcacctttagcattcaggattgatacaaagatgtagagaaagacagatatagatgagtacactatcctgtttcactatctgctctgtctaagaattcatgcaccagtgtcacattgttttaattttttggtttactaatatgtttgaaaatctacctaaagttagtgccttctcagtatacctttattctattaaacatttctggctattttcatactttgttctcatgaatattagcatcacagaactagttgtattctttttgtataaaaaccattgaataatgagtgtttattttgtccctagatatcttaggaaaattttacttataagttttttctaaataaataataagtttcagagaataatggcaatgtttaccatttttatacctctaatttctaaatgtgttggattaaaatatccagaagaatgttaagtaacaacaataatctgttcttggcttgcttctgacttttaacctaatgcttacagaatttaaaatcatgaaaattatgctgatgtgtacatttgaaataaattattaaaaataagaaaattgctatttacttttattattatttgcttttaatttttaatgcatatcgatttttaacaaatttattttatcatatatttatgtaattttttcttactgtattagtcatcatcctgcagagaaacagaaccaccaacatagatagagaaacaaagtgacagagagagtaatagaatagtagagaggagagagacaaagagactaattttattatgaagaattggctcacaaaattgtggaggcaaaaaatatcatgatctgcaatctgcaagctggacacttaggaaagccagaggtgtaattcaatctgagtctgaaggcctgggaagcagggcagccaatggtgtaaaccctaattcaagtgtaggtgaagataagatgagatatactagttaagcagtgagacaggacagaaagggtcacactcctctatcatctgccctttgttctatgcaggccttaaatgggttggataatgcacatcccatattggggagggaagcctactttacagagaccagttcaagctgacacatacaatttaccatcatactttcattttcttacagattctggagatttaggtatttttatatgaattctagatggctgatgggttgaatttttttttttttttttgagacagagtctggctctgttgcccaggctagagtgcagtggagagatctcggctcactgcaagctccacctcccgggttcacgccattctcctgcctcagcctcccgagtagctgggactacaggctcccgccaccatgcctgactaattttttttgtatttttattagagacggggtttcaccattagccaggatggtctcgatctcctgaccttgtgatccacccgtcttggcgctgggattacaggcgtgagccaccgagtccagccaatgggttgaacttatttagaaaatgtgtttgcatattatgtcctttgtttctcttaacatcaagtttgcaaaattaactttaaagatctgattctttttatttccaattcaggagataatgtaagtcacatttgccactaactagtagtaaggcccatagcccaggctagatggtgagatgtacaaattcaattggggctttagtagtgattttaaatgaaatgtttttaagtttattcagcacctactctttttaagacttgccctccttgtgtgggatacagagattaaaggtacaattcttttttgtttgtttgtttttcatttttttaattatactttaagttttagggtacatgtgcacaatgtgcaggttagttacatatgtatacatgtgccatgctggtgcactgcacccagtaactcgtcatctagcattaggtatatctcccaatgctatccctcccccctccccccaccccacaacagtccccacagtgtgatattccccttcctgtgtccatgtgatctcattgttcaattcccacctatgagtgagaatatgtggtgtttggttttttgttcttgcgatagtttactgagaatgatgttttccaatttcatccacgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcgtgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgatggccattctaactggtgtgagatggtatctcattgtggttttgatttgcatttctctgatggccagtgatgatgagcattttttcatgtgttttttggctgcataaatgtcttcttttgagaagtgtctgttcatgtccttggcccactttttgatagggttgtttgtttttttcttgtaaatttgtttgagttcattgtagattctggatattagccctttgtcagatgagtaggttgtgaaaattttctcccattttgtaggttgcctgttcactctgatggtagtttcttttgctgtgcagaagctctttagtttaattagatcccatttgtcaattttgtcttttgttgccattgcttttggtgttttagacatgaagtccttgcccatgcctatgtcctgaatggtaatgcctaggttttcttccagggtttttatggttttaggtctaacgtttaagtctttagtccatcttgaattgatttttgtataaggtgtaaggaagggatccagtttcagcttcctacatatggctagccagttttcccagcaccatttattaaatagggaatcctttccccattgcttgtttttctcaggtttgtcaaagatcagatagttgtagacatgcggcgctatttctgagggctctgttctgttccattgatctatatctctgttttggtaccagtaccatgctgctttggttactgtagccttgtagtatagtttgaagtcaggtagtgtgaagcctccagctttgttcttttggcttaggattgactggacgatgcgggctcttttttggttccatatgaactttaaagtagttttttccaattctgtgaagaaaggcattggtagcttgatggggatggcagtgaatctgtaaattaccttgggcagtatggccattttcatgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgtcattggtgtataagaatgcttgtgacttttgtacattgattttgtatcctgagactttgctgaagttgcttatcagcttaaggagattttgggctgagatgatggggttttctagatatacaatcatgtcgtctgcaaacagggacaatttgactccctcttttcctaattgaataccctttatttccttctcctgcctaattgccctggccagaacttccaacactatgttgaataggagtggtgagagaggacatccctgtcttgtgccagttttcaaagggaatgcttccagtttttgcccattcagtatgatattggctgtgggtttgtcatagatagctcttattattttgaaatatgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgtatcccagggatgaagcccacttgatcatggtggataagctttttgatgtgctgctggattcgttttgccagtattttattgaggatttttgcatcaatattcatcaaggatattggtctaaaattctcttttttgattgtgtctctgcctggctttggtatcagaatgatgctggcctcataaaatgagttagggaggagtccctctttttctattgattggaatactttcagaaggaatggtaccagttcctccttgtacctctggtagaattcagctgtgaatccatctggtcctggactctttttggttggtaagctattgattattgccacaatttcagatcctgttattggtctattcagagattcaacttcttcctggtttagtcttgggagagtgtatgtgtcgaggaatttatccatttcttctagattttctagtttatttgcgtagaggtgtttgtagtattctctgatggtagtttgtatttctgtgggatcggtggtgatatgccctttatcattttttatttcatctattagattcttgtctctttttttctttattagtcttgctagtggtctatcaattttgttgaccctttcaaaaaaccagctcctggattcattaattttttgaagggttttttgtgtctctatttccttcaattctgctctgattttagttatttcttgccttctgctagcttttgaatgtgtttgctcttgcttttctagttcttttaattgtgatgttagggtgccaattttggatctttcctgctttctcttgtgggcatttagtgctataaatttccctctacacactgctttgaatgcgtcccagagattctggtatgttgtgtctttgttctcattggtttcaaagaacatctttatttctgccttcatttcattatgtacccagtagtcattcaggagcaggttgttcagtttccatgcagttgagcggttttgagtgagattcttaatcctgagttctagtttgattgcactgtggtctgagagatggtttgttataatttctgttcttttacatttgctgaggagagctttatttccaagtatgtggtcaattttggaataggtgtggtgtggtgctgaaaaaaatgtatattctgttgatttggggtggagagttctgtagatgtctattaggtctgcttggtgaagagctgagttcaattcctgggtatccttgttgactttctgtctcgttgatctgtctaatgttgacagtggggtgttaaagtctcccattattaatgtgtgggagtctaagtctctttgtaggttactcaggacttgctttatgaatctgagtgctcctgtattgggtgcatatatatttaggatagttagctcttcttgttgaattgatccctttaccattatgtaatggccttctttgtctcttttgatctttgttggtttaaagtctgttttatcagagactaggattgcaaccccagccattttttgttttccatttgcttggtagatcttcctctatccttttattttgagcctatgtgtgtctctgcatgtgagatgggtttcctgaatatagcacactgatgggtcttgactctttatccaatttgccagtctgtgtcttttaattggagcatttagtccatttacatttaaagttaatattgttatgtgtgaatttgatcctgtcattatgatgttagctggttattttgctcgttagttgatgcagtttcttcctagtcttgatgatctttacattttggcatttattttgcagtggctggtaccggttgttcctttccatgtttagcgcttccttcaggagctcttttagggcaggcctggtggtgacaaaatctctcagcatttgcttgtctgtaaaggattttatttctccttcgcttatgaagcttagtttggctggatatgaaattctgggttgaaaattcttttctttaagaatgttgaatattggcccccactctcttctggcttgtagagtttctgccaagagatccgctgttagtctgatgggcttccctttgagggtaacccgacctttctctctggctgcccttaacattttttccttcatttcaactttggtgaatctgacaattatgtgtcttggagttgctcttctcgaggattatctttgtggcgttctctgtatttcctgaatctgaatgttggcctgccttgttagattggggaagttctcctggataatatcctgcagagtgttttccaacttggttccattctccccatcactttcaggtacaccaatcagacgtagatttggtcttttcacatagtcccatatttcttggaggctttgctcatttctttttattcttttttctctaaacttcccttctcgcttcatttcattcatttcatcttccatcgctgataccctttcttctagttgatcgcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgacctcccgtagctcagagtaatttgatcgtctgaagccttcttctctcagctcgtcaaagtcattctccatccagctttgttccgttgctggtgaggaactgcgttcctttggaggaggagaggcgctctgctttttagagtttccagtttttctgttctgttttttccccatctttgtggttttatctacttttggtctttgatgatggtgatgtacagatgggtttttggtgtggatgtcctttctgtttgttagttttccttctaacagacaggaccctcagctgcaggtctgttggaataccctgcagtttgaggtgtcagtgtgcccctgctggggggtgcctcccagttaggctgctcaggggtcaggggtcagggacccacttgaggaggcagtctgcccgttctcagatctccagctgcgtgctgggagaaccactgctctcttcaaagctgtcagacagggacatttaagtctgcagaggttactgctgtctttttgtttgtctgtgccctgcccccagaggtggagcctacagaggcaggcaggcctccttgagctgcggtgggctccgcccagttcgagcttcccagctgctttgtttacctaatcaagcctgggcaatggcgggcgcccctcccccagcctaactgctgccttgcagtttgatctcagactgctgtgctagcaatcaggagactccgtgggcgtaggaccctccaagccaggtgccggatataatctcgcggtgcgccattttttaagcccgtcggaaaagcgcagtatttgggtgggagtgacccgattttccaggtgccatccgtcacccctttctttgactcggaaagggagctctgtgaccccttgcgcttcccaagtgaggcaatgcctcgccctgctttggctcgcgcacggtgtgcgcacccactgacctgcgcccactgtctggcactccctagtgagatgaacccggtacctcagatggaaatgcagaaatcaccgtcttctgcgtcgctcatgctgggagctgtagaccggagctgttcgtattcagccatcttggctcctccccacaaaggtacaattcttgacagcatgacactcagagttaaagatggtattatttggcttaaaaaccacaaatactgacaaatataaactaaacttatgagtttgctattttactaaaatatcattggttaaaatactgatctctttgcttctctgttacctcatctatacattcatgaactggaaataaaattatggttagattaggccaggtgtggtgcctcatgcctataatcccagcattttgggaggctgagtaggccagatcacttgaggtcaggagttcaagaccagcctggccaacatggtgaaaccccatctctactaaaaatacaaaaattatccagatgtagtggtacatgcctgtaatcccagctactcaagaggctgaggcaggataattgcttgaacctgggaggcagaggttgcagtgagccctgattataccagtgcactccagcctaagtgacagagcaagactccatctcacaaaacaaaacaaaacaaaaaaattacaatgagattagatataggtaaatgttagacttaatgcttataaagtacctagctcacagtagatttatagaaaatgttaggctgccacctttttttcttctttgtttctttcatcatccatatttctcctttacttaattccgatgaaaacctttaatgcatattatgtaacaatatatattacattaaataaattaaaatgcaattaatgatatttatctgcaatgcacataaagacctactaccttgctagaatttggtcccaaatttgacccaagtataccagaaatgttttaaaatagtgttgtggattgtgtctgtgtatgtgtgtatgtatgtgtgtgtgtgtttgcgtgtatacatatatatatacacactatatatttgtacataataatgagagagcgttgaatgcaatggcaattgatagaaagtgcagtacaatttttaaaatgtaaaaatgtttctgaaaggaaattaaatcaaaatttgtccttgatataacaagtattaattcaaaaaggaagtattggaagtggaagtgatgtccagacagaggaaacagcatacccaaacattcaaagtgaagaaggccatgatgcttgtggagaatctacttctacatttctttgttccagtcttctgttacacacagctcatggaaactgctaaacacactgagatccagtttagaggcatttcttgtttacacatttttaaaaatttcaccttaaaattctgaaaatatagagaggtacagtgtgctttcagactatttccaaacttctaaagaaaaacagagaaaaactaggttaacaaaattaaaattcatgaacaatatttacaacaacactgggtaacaatgtgccctacaaaaaatccccagtgtaaatagtgacagacaaatcaggaagacctgcaatatccatgaggaatcagaatcctttcaagatgaagcagagggtgaacacaatatattatggatttgagaacccccaagtcagcaacaaggatttattagaaagtgggcaaggcaattaaaaaacagctacggaaactaagtagggtgggagtttgcacacatcaataagcaagagtccaggatgagataaaaaagaggctgggaccatatggcttctacaactcttaaaataaccagaccaaattctcttccaggatcaagttccgtattgagaagaatttactgtaagtaaactacatattaaacaaggctgacacaatagggccaaaaaaagagaaggcctctaaaaagtaagtggggacagaagcagaaccaggacagagcaaaaagtgaaaggtcttattattgaatatcttataaaatcaacaggagagctctagattcaggatgctaggaaagctatcttgaccgatctttaccttataaaagttcaagtttaattccatacaaatggcatcaatacggcatgcttttgttgttgtttgtttcttatttaaggagagtgcagagggaagaaagtgcctttcccaaaatagtataccttgatatgactgttcatgaagtaacgtctagtgtttttaaaagaaccttagtgccagggctacagtgagcttatattctgcagctgcaaccttgagagaagtgcttctgggcagtcctctttgtttccttcccagcagaacctcagccccacctcactggatccagctccatcactgtgcctggccacctcaagttattcctgaaggtcaatttctggagtatgtcctaatcctctcctcctccaagcacccctcttggtccctgcaatatccctcccgaacccccacctaaaagcctttctgcctgcccttgtcccataatacctcacccaagaatgtattataagccagcgtggtggctcacacctacaatcccagcactttgggtggcctaggcagacggattgcctgaggcaagaagttcgagaccagcctggccaacaagatgaaaccccctctctactaaaaatacaaaaatcagcagggtgtgttgacacatgcctgtactctcagctagtcaggaggcggaggcatgagaatagcttgaacgtgggaggcagaatttgcagtgatagagatagcggcactgaacttcagcctgagcaacagagtgatgacacagtgagaaaaaaaatgagaaataggaagaggcagaggtaggtatctatctacatatcgatatatctatgtatttagttatgtataatatatatgcatattatacatgtacatgaatatatgcattatatgttgcttaatatgtagtttacttccattattatatatatagtacattatacatgcatatatgagagagagatctcaaattgatagaatccctaataacaagcagctaccacccccatttttcacaatggctaattactttactgcgtgatttactctcagatatggtactgaggaccacgaggtatatccagcaaattatctgcaaattcaagtgcaagtttttggctttagaaaatgtttcaaatcagtcagttacacttgggaaatgaggttaggaatatgcacccaaagggttgatcttaactattcattatcactagtgggaaaattctggagattaagggatgtttggggtggctgtcttgctctgagaggggtatgggtggggaatggatttatcctcttttccttttgtgttaataatggtgggagattttggttactgtgaatagtacctacatgagctggataaatcatgagcactaaaggttttgggagggtaaagagaggggctgcagggactgcagggaggagggaccggggctttttcagaaagtttgcagagagaaagcagtcagcttctctgtccatcatccacagctccaggattaaagaaaactctgctttctccctgcacattctctttgtatctgcaagagaaagtagatgggttaaaattagtgaactgaaattagtattttccagaaagacaattgaatcactaccaagatatgtaaaggcaactggggccttgtgaggccacccaaaccagcctccatccagggtaatgaaaggggatccagttgtccccaaagctggagatttcaggtaattaggaaagagccaaggaggcagtggaggggtcaggttaaaataaaacgccttgtgtaatatctgcattaatgggccaggctaggaaagaaaaactggtaaatataagttgatagaagaaaaataggagagaaagttttattttattttttaaaataactttctgaaaccaactttatttatgtgagttttatggaagaaaggactagaattaataggaataaaaatatgtgtgtttagcaaaggaagttggtggtcagataaagaatgtagttgaaaagatggtggtggtgagatgaagaacatggtttctgtaaactgttgggaatgaaatatttcactgacttcaaaagagatggaaagtttcacaaatgagtacagagaacatactcatgtggtgaataaatatgctttgtagcctgtcaggttctttcccttacactcttacacctttcttttgctttggactcacggaatcagggataggtcagtaacctgactaaaggtatcagaaacaccagcttctgagaatgctaacatactgactacttgattttctttatctatttctatgaaacattttctgtaccatttttaaaagtgtagaggtaacattagttttgattttctttaaataaaaatattctctcttagaatactgtgcatgtctttccttttatgctatatcttttcttttcccttgatctctaagccagtccaggtaaataaatacctgagtgtgtttatccaaactgatgggctaatgcaagagcacaggtttcttccccctgacctggaattttcctttctctgttagacacctgctaagtcccaattcatcaagtgtaagtttcaacatttcttcagggaattatttctttagctcctggactagattaggttatttgttgtatagactcagaaaatcttatacctttctttgtaaaactcacaatgtaatattgggcttcttttctggttttcaaattgcaggagaaggatggtgtttgtactacacacaggtatattccaagaaattacacaacgcttaatatataacatattcaataattgtttgaataaaagaataaatgcacaaaataattgataaaaacatgtgatacaactgtttaaaaggcaaccaaatttacccctgtatttctgttgattttggctactgaatgtaaccaaaatcaatagggatactgagaaatactatttaataaagttgtaaattggactgcttatcaaattgataggctcagcaaattttctttagctcagtcacaaactattgatgaacacagatcttaacagaatgacaatgatacaaataaaaagactgaaaatctgtaagattttagtaatttcactgatggcatcctacacacacagttacctgggaacatgtcattagcagaatagaaaataagactcaattttgcttcagaaaatacagaatactcagaagcctcattgcattttaataaaattccaaatttatttagttcttagaaatttttaaaatacatgtgcattaaaatatccttattatcagaaatacctatattttgatcatgttaattttgtatgaagcctttccttaagtatcgattggaaattggttccaggactccccagggatatcaaaatccttggatgctaataatcctcagatgtccttacataagatggcgaggtatttgcatgtagcctaagcacatcctccaatgtactttaattatctctagattacttaaaatacttaatgcaatgtaaatgctatgtaagtagttgttacactgaattatttagggaataatgacaagcaaaaaaaatctgcacatgttgagtgcaaatgaaaccatccgatatttttttcctgaatatttttaatccatggtgagttgaatacatgggtgcagaaccctatcatatggaggtccaactgtataccaaatatcatatataatggtgtattttctgatatttaatttaattactggcaatatggcacacaacaaacatatccaaagtttttgatatgtagttttttaatttatttaaagcaatccaacaatgcctcctttaatgaagattgctgacagcaaagtctaaaaaagactgactccatctataagcagcaggcctaatccaaaagtttaatgacagatgggttgcataatgggttatttcaatgataggagtaatgcaaacatacaattctgtagtcatttatattttaattgtattatactcttttaaccatcctcatcttgtgtattatctcattgtgtattagaatacaactattagagcaataaggaagagtggatgaatacggccagttttttgttattgttttgttttgtttttttgagataggctctcactctgtctcccaggttggagtgcaatggtgagatcacggctcactgcagcctcaaccaacccagatcaagcaatcctccaacctcagtctcccatatagctggctacaggctgcaacatcatgcctgagtaattttttttttttttttttttttttttgagaaacagggtctcactctgttgcccaggcttgtctcaaactcctgggctcaagagatcctcctaccttaacctctaaaattgctgggactataggcacaagccactatgccaggcctaaattcagccaattaaactgaagtttaaattatttgtgtttcactctctttcattataaaaaaatctgtgtcttaaaatgtgttcttgaatatgaattactttatgattgcaccttcataagactagttcttaaagtttaagaataattcatgaaaatatgaaaattcatttataaaaaatgactagcattaatagaaggaatactaggtacaggcagtggataataaaactttaagtgcattatatcattctgtcctcacaattataagagaaagtggtcctcccacctcagcctctcaaagttctggaattataggcataagccaccatgcctggcctaaatatggccaataatttaagcttcagtttaattggcagttcttataagtttatgagagaaatatgtttttcttataattgtgaggactggattagaaaatgcacatacaacctccactgatagggtagactctccactccggaacaggaggtctagtgttgctatgcccaagtttcccactggctgtatcttccatccctcaagggataagacaaaacacctggggacaccatccccctacctaccccagcgcagacttgtagggcgtgtgtgagtgctagtgaagccactgtcaactcctttgcagtgatgtagagattcatctaggaggactgacaggccagaaaaactgagagctttgctcaatgcctcacattaatgactgattttgaatcagtcatgaaaaggtacattcccaagggcattgtaaaaaacaatggagatcttggttaggaacattaaagaggagcttggaatctttagcatgctttgtagctacaaataaacttctggcagacagcctgaattttaccaaagaaaaccaggcaaggagaaagccaagaaaaggtgtcttaggatcactaatttctggagatctggaaggctgtgtatctgtgctagactgcaccctctcaagagcaatcaaggtggaatgtggacaaatttgtaagcactccccaaactaaccactgattcatcagcaaagagcctttagccctcctggctaaagagctaaagcacaaattctgagtgaacactgggtaaacaataaattattctattccagggagtggctcctagaagccagacttaaaaacaaaaccacattcatctctggtgatctggaagcctgacaatacactgtcttagcagtagccggagagaggacttctgagctgttagtccactgaatgtgggatgtaattgtaaacttcctgaccagtgaaagctgtctccaagccacacacattgaatgataaaggataaaaatctaactagaagggttagacacaacttttgaaatacagatttaggtagaaatagagataaatagatatggatattgctgagtttaatgtttaactgaatttatggtaaatatttatcatcatgaatatgttcacctcagaagccaaaagcatagctactctcacatgaaggttatatatatatatgtgtgtgtgtgtgtgtgtatatgtgtgtgtgtgtatatatgtatatatatgtgtgtgtgtatatatgtgtatatatatgtgtgtgtgtatatatatatttcaaagtagtcatttatatattttttaattagtaagctaattttgcaagcactattactttatccatgaagtaaatatatatatatatatatgtattctagtgaagtataaactaaggtgctttctgcataagtaacttgcagataattttatacattatatgtattttttaatttcaacttttattttagatgcagggggtacatgtgcatatttgttacatgggagtattgcatgatgctgacatttgaatacagatcctgtcaccttggtagtcagcatagtacccaataggtagtttttaaaaaacatattattgttatttattaatgtggagaagagccttccgaaggcggctgcaaatgtccttgtcacgcagaggcagcagtggtcaggagctctgccgaccattgctttaggtgcctatttacaaggatgacattctgaaaaaaatggcaggaaacttcagaagaaaaaaaaaaaaacccttttcttccaaagtagatatgttctgacactcacaccttcaggctgttgcccctgtgggaagtgaaagatgactggtttctggcagtgtgacaccaggagcatgctcctgggctcatggaacagactgaagagctccctccaagacaagcttcccacagcccttccctttctttcctctgaaaatctgtatatttcttttcaagccaccacttaaaatcttattttgttcctactcttagaaacagtaaaaaagagccccatactggccattttataaattaatgtaattttaaagcagtgggacattaaggcattatttgtctctctggccttggttccttttctgcatactgcaatcattcagctacatcttacactctaccatgtccacgacactgcttatgactagtgactagaagactgaacatcacttgtgcccacgggcagatagagagaaagtcatctggtcacattaccactttggtggaaggcactcttataaaattcatcagccaggtctgctattataaacactgggtcaaaactgtagttgacttcgaagtgttctcagaaagtctgataatacactattaaaagacaattttccatctgaaaacctgactggtggcaaccttcaattggcccctgcatttcctctgagctgaagcagccaagagatggaatcgtttgcatgaggagttcttactgccactaaggttgttagaaaacatggaatgttccttctgccctccgggtgattgaaagctatgcaaaacaaggttgtttctttctgagaggaaggaaggaatgggtaagaaaacttttaaggcataaataatataaaagggcacacatttcaggatgcattcatatgacattatactacaaagaaataaataatgattttctttgatttgaattaaagtccttcacatagtccattcacaggcctgttttgtgcagttggttacagacttcaagtcagaacatgactggttgtttgcacatcttccagtttcctggggctgctgtaggacctctgaggggctgtctaaaggaacaccaggcagaggccatgttgtcttttcagcacagtcctctgagataggtggcaaaaataaaaggattccaatgtaaaatgttgctgtccatttctgaagagacacagctgtctcctctgctgaactcttctggatcttctgtgtgattagagctgacaatgtttctattatcctgacagcaagtatgctgagtagagattggttccacattgttcttgatgctctcgtgaggcaactggccacaatcagggatgcagaagccaggcatacgggcatcttcatttgactgaggggcctgattcccacaccatactgaggacaaagtgccaccctagagaccacaggaaaagggctactgctgaaagtgctgttggttttggtgaaacagctattgttgtttcaacaattttgacaattaacacattccagagggtcaatctgaggcactgctatgtacattccaccaccgttcactagatgatgaggctgttcaaaattcacatgtcctggttagagagttagtgtgcccagagtaaagtcctccatttaagctcccattcacagttgcattgactccattggagaccttatggtgaaggtgggaacagccactgctgagaccgccttggctcaggaagccttcatgaacatttccatttatctcatttgctcctgagagagtggtgtgttccaccatctgcccattaatatctgatccctggtagagataacccagtgggtcatatttctctatgatattctgctggtgattcttccacaggcacattgcaataaaaagccacaaaaataaggaccatgacacccagcatacagccaaggatcagatataacatgtctgcttctggcagggctggttgctggcctcacatttccttcactttctgaagaattcagagggatactcaagcctttaggatactcagaatctccaggaacatgttttactttactctcgcagatcaccacactgataaacccactttcttctccttcactgaagcactgcattttaatgccataggaagtttctgacaggacatggccaatcatgtgccactcctttgaaccttctactacatccctcttgtaatcactgtcattgtcactatctgatggtcagtaatagttataaaagaatggaagtgttattgttacttcatggaatgtatgtccactttagcactatctgggcaacactgacagcctctgtgtaggcaatgtgagttccattattggatggctgaaaaaatgactggggaacccagccacctgataaggacaagattctggactcttaaaactcccttcctaatgattgatagcaatgactctcaattatttgtatgttgaacccagttctaaactatgaacttccatggaaattttggaagcaaggatatcttcagctgccaccagccaatcactggtcctcatcctttcatattcaactttgaaagcagtgattacagaaacccaattttccagaagaatctgagtgacgtagaccaatgtctctgatgctttggagatagtagggccatttgatgcctctggaactttgctgtgccttcaagaatctgtaagtaccactccaaaattgtttgcagcttctgaaacaacaggatacttatggatgcccatgggtggacaggatgcctgggtgttttttgtcaatgctcttttttctttgctggttcagaaggtaagcatggcagtttgtccttcacctgctccacttcttgctactatcaagactttgtaaagactagatggccctagttcagctaaatggagctcattttcactacctgggactcgaaccatatgccaaattcctaccaaaccaaccccattgttcatcttctgatatttcataaaatacacattaatggatagcccaccattcctgcctgccctccacaccaggttgtacgtatctggtgtgtgggtctgttaggagatcagtaggatgggggcgtcaggaacagcgatgccattaacattttcctctgatgctgattgtgcactgcactggaatgtaccttaactggacatgagctcaatccagtttctgaaccatctcttttatttctttcatcattctgagtagcagaagaaagtgtgactgtttccacttttgtatttgtttcaaaaggaacaaccatgagagatgcttctccctgcatggtactctgtccatctggagcttcctatatgtgtttccccacatgtttctgagtcacatcctgaatatggagagagctagagccaacttgggacatgatgaagtagacaggcttcaggtccaagattccaggtcttgataagtgtgactttggggacttagatctaaggacttaagacagatggctggctattaatccatagctgtcataaccaaggaatgactggaactgacagcccagtggcattgcaggacacagtgacaaagtctccacataccacctttgcacttattggtgccatgattataactggcttgaatccattgtcttttttcaatttcaagtcttccagtagactgcataaatccagtcccattatctgtcaaacactgatacagcccagtatcttccatgataaccctactgactttcagtcaatttcctgcagttagatgtcatggggaaggatgaataggctgtgcaatataaaaccaagtatggttggcggctgggtttccatgaatatgacaggtaaaatgtactgtggcacccagagactgatcctgtagtcctttataaatgggagcatattcaagcacattaaccatgtatgtcacatattttacatctccagtcttatttcccaccatgcaggaatagtttccagagtctgctgggtcaatgctatctgtcgcaacatgagaatataaccttctccagttgcttcctggagcaatattccctgtcctttagccaatacacttgaggatccaggaccccactaaccacacactgcaaggttagaggaatatgtgaaaaaacaactaatacctgtgaacaagcaggatgaagaatgtcaaaatcatctgaagaaaggtgactcataaggagcttttggccaatgggttcaacttttaattcatgtatgacaggattataagccacatatttgtatgatcccttgtcctctaaggatacatgcaaaatgtaaagatgtcctgatggaaggattaagtaattctttatggagtgtttcagccacttcccatggattttagcgcacacctcagctttggggttactctctggtaccctgcagccaatgaaaccagcacttttttcttctgctgtaataacatgctttgtggatgaaccaaaatcaccaagaagtgctgtggatactgttacagggccacttacaacaacatcaacctactgttggaaatgcattggtagtaacccaaaagggaggctttaagagaaaaaaattgtcaaagtcccctgatgattcttaatatatccatgtttctatcctatttttttccattatgtgaccatgaaatatgagtggtcacaggtttagcagaacaatatagttttacaggtccactgagtttctggacggcagagttgctcaaaaatgaaataaggtgccacgtctgaactcacagaaaggcagagaatcatcagagtaacatacagtagtgtccataaagggccaagatctggatgcagagcaccagattacagaagcaggcaggacagacttccatatccaaacccaggccttggttcattttccatagtaatgcagaccagggtaatcaaacacattctttaatcttgactccttagtgctcactaaagactctgataagggacagtcttcatgccgtccacaggggtctcccaatattaagagtaacagctgccttacatcttcagtgattcaagtctgcaaggtgtatagacttctgctggggagggaaagcagagaagccactttctgtacttagcctggaactcacttcaatgctgtaaacatcattgcagtcctgcttgtaataaagtccggactagcaatctgcctttgagttgagcttttctcttacaaggtaaattgttaagtcatgccttgattttagatctctccacggagagggctaagcatccagagctcctgcgtggcagccagctgggaaagccacccctatgtcatgctctcccgctggcggcagcagctgtggtgacggctgcgatctgaaggggcccctccaggccccgcacagggcagaggagggtgtggtgcctcgcacgccagggcagaagcactgggtaggaccggagggtgcggggtcccaggtctcctcgcacggagcggcctaagccgggcacccgggctcaggggagggtagctggcggggcggagtgacaggacgcgcccctgcagctgcgcttctctgggcggaggcttgagggcaggtaacccggtgggcacaaggcctgccaggagcaggagagcagcaggaggagcgattcggagagagacagacggggcaggctgtagagatggccctcaataggtagttttttaacccatccctctccctccaccctcaagtagtccagagtctatttttcccatattgatgcctatatgtgttcagtgcttagctcctgcatataagtaagaatatacagcatttggttttctgatgctgcattaattggcttaggattacagcctccagctccatccacatttctgtaaagaacatgatttcattcttttttatggctgtgtagtattccatggtgtataagtaccacattttacttatacagtgtgtaattgatggacacctaggttgattatgtctttgttattgtgaatagtgcagccatgaacataggagtgcatgtgtcgttttggtagaataatttattttcttttgagtatatactcagtaatgggataattggatcaaatggtgccagttacatttctgcctgctccagtcttttttttatttgtttgttttcccaaaacgactgccttattgatctccaacttgcgtagtcagtctccatagtaatatgtcattattttctttattctccctcctgccctcctactggttctgcttctccagttgaaccctgactgatacaagactaatagatttattttcactattaagatagcattatataatttcttcattactctgcatatcattctttggcagactaagctaatcttactaatataatcaatacccacacatggttagctcatgctttatatttgggagatttaactctcataaagttaatacatactaaacattctgttagctaagagaaaaccctggagattataagaaagacatattagaaacttttcaattaattcaggccaacactattgtgagttttccacctcagctgactttacattttatgaacttatttcaaaagtcattttctttagtcaactccagagagtacagaataatataacatagaaagttatagtcaacaaattaaaataaaaacaggttattttcactttactaaatattgtttgaattccttttttttttcttatatatgtccagattttgaggcaatttattctttggacttccaaatccttatttcttgctctattttcttttccgagttgaacattcataaagccacctagatattacgcaggctcttaatataaattacagccacttcaagttcctcacatccaaaaaaacccatcaggttttgttcttgaaaagttattctcatcttgtcttcctggtttcaggaatcagtatgactacttacctccttatccatactggaaaactaagatttagtttagatgatgttttcttcctcaacctctacatcctatcaggccctacacagtgttattaagtgattaaactttaaatgtctgtcagatatattttgtccttcacatttctaatttcttctttcttaattcaaagtttcattatctcctgcaaatttcttctaatttttggacttacttccgccattagatttagcctcactaattgtttctgaaaaaccactttccatgggcactaggtggccacccactggattctccttaggtgcttgtgcttgtgcctgacactgagggacttgtaggtgaacctgcccagtatggccctgcccatgttgccccagctgaccccagagctgaggagggagctgggaacattgtgtactccacgaatcagcccattgcctggggcttcttctagtaaacaaggatcaagtataaacccagccatgttggtcaaaaccagctctaacacataagcacatttactggcttgtaggtcgaaccaaccatgttggtcaaaaccagctctaacacataagcacatttactggcttgcaggtcgaaccgcacagcccaataaaaaaaacctgtagacagaaatgcctagggctgtatgagagaagctgaaagaccaaccaaacccagcattctctacatcaactgacctttgacaaagcaaacaaaaatataaagtgggtaaaggacaccctattcaacaaggggtcctcaaacccttggcctgttaggaacccggtcgcacagcagtaggtaagcagcaggtgagcgagcattaccgtctgagctccacctcctgtcagatcagcagtgacattagattctcataggagctggaactctattgagaactgcgcatgcattggatctaggtgacgttctccttatgagaatctaacccgtgatgatctgaggtgaaacactttcatcccgaaaccatcccccttcccgcttcccaggaaaccagtccctggtgcgaaaaaggttaaggaccgctgatctacagtcatactaggaaggaggaaaaagagaaacagtggggtgggggacaggtggggacacaaaaacaaaccaaaaggaaactcaataacattacaggaaaatttaaaaatatcctatcggcacaaaagtaattacaaaaattagagatgtctaatcttggaaataggagtccataatgaactccaatccagccaatttagattcaaaacccatctcttaaggaccagctgtcctacctctccaaaaagatgggttgtaaaggaggaataagcaattatttttttcttcaataagcaattatttttttcttcaataagcaattatttttttcttcttggtggctcatttaacatgcacttcatcaagaatttattaagtagggtggataatagcttttcttggtgcagaggaaaaaggaaataaggttttatggattctgacaattggcaaataagcctgaagtataatggatttatctgtgataaagcaaggaagtatcagtaagattcaataatagatggataaattggtttatattctggctaacccaataccactgcagaattatatgaatgtaaggagaaaatcagtgtttagttttagaagatgcctctatttctccatgaggacagacaacataatttagaaagactgaaaatagagggcaagaagaatttttagtaacttcatatatatatacatatgaatatatatatgcacacacacatatatatgtgtgtgtatacatatgtgtatatgtgtatgtttatgtatacacacacacacacacacacacacacataagaccagaatgtctcataacgggggatcttaaaaaggaaatgcgccacaagccagatatggacttgctcaggtgagaaagatttagggtgtcaaagtgctgaacattcacatgcatggaaattatttctctcagatgaaatccacattccctcccactttcattatttgtttccaaaaacatacttctataactgtggctggtttattgtatgccctcaaaaaattctctagaattcgtgcagcttacttatactttatccatgaacaaatgaactttgcgaattggtgaatgtagaagaccgaaggaaaactggccatttaaatgaataaaaatttatttaggtttttgtaaatccataaaataatatttaggttaatattttggtcatagaaatatgagaaaagcttgagattctagctaactaactgccttcctcctctattttctctttaactgttatcactggatttgtatcatggtcatctttgagtcagatatacctaagaatgaggccttgggaatttttggacaactcattcatgtttataacagagcacattggcttcccagatctccttccccccgactcactctgagaagatccttagaaataagacttcttcagaggtttcccctctgtcaatctgctcaattgggagtctctattttaaagaaaataggcaatgacttctcaagtatgaggaaactgaggaaagactatttttcaaaattgtctcaagttcttagacaggacttagtgaaagagatgtcctgtgaagaccactaagcctcctgtttttgccttcactggcttttgaagacataatgcacagttgagtctgtccctgattccagcagatgcactttcagagttttcacaagagctactgaaatgagctcacacattattaaaatgttaactcaattttttatgaatctatttttcccttcctctgatacagagatgtttctggtgttcagtaattttatttggcatggtttaaaagttgcaaaagaaaaaaaaacaggatcctaataatctgttccaggttaattttttagttctaaaaatcctatgcatatgtgaaagtgctaagtttttttaagtgtaacagaggcaattactttagtgaatgcaggaatggtggatgccagaatagaaaaggagagaaggagtctcccaggagtgaaaaagctagtgagttactcctgtatgttacaattgacagctagaatagatgaaagagaccctacacgtgtgagaacaatgtggtcccaagggcagctctataaaccaatctcacagcctccactttggcaaacaaacacacaaactactagccttgaaaaaattccattgttccacacagggagcattgcaatggagtctggtaaaaactgtatactagcattttattactgaatattctcaagacataagagagtcagggtctttaaaaattactagttattagaagtaaagaatagacttaattctgactgagaattttcatttgatttgaaaatttaggagccacaaataagaattaatctgggaaaaacaaagtgatgatattgtagttttaaaattatggaataaaataagattttgttgaagcatcttaaatacataatactagtgatttttttttgtagctatatgaatgttaactgcaaatttttccttataaaagtgaggcagtatagctgcaagtgccctaggctgtgaactcagagctcagagcagggttgatttatagactgattaaaaagcttaactgctttctatgtaaggggcagcccattagcaatacgctcataatctagtattttttgtgtgtgaaatcatatggataatctttttactttaattattgaatttattttcagaaattattacatcattttgaccgtacagactttttataattgcatacatccttgtaatcatattggcaagatgcagaatgaatcagtatgaaacttaaatagatccaggctcacaattggtgacttacataataggcaaacagaatgacaaagggaaaaaaggaataaatggtgcaatgttcagagttcaggtaaattattcaatgttatatataaaattgtacatttattcagtatatttaatttttatttgctaagagtagatttttggggttgtctgttgtactggtgtgctgttctttatattatttttacaatggcatatattattcatatgatataaaatttgaataaatattaaaattgtttttaaaaaactaaaataaaaactaagtaaggaagcaaaaaaaatttaacttacagtatgaagagctaatgttaaatcagaaaattcagggcagcccagtgtgaatgcagagaatcagacagactagaattttaagaaaattatttataaataacacttctaaaatgtttatatatatatattcacttcgaaaaataacatgtgtagacttccttttgttttctagggaagaacttgaataaatggcaaattctcacatccttggcaaatgatgttgttatttagaactaagaaatgttttcctggaaattattatttagaactaacaaatgtttccagccatctctgatagctgaaaggagttaatgacagataatttatagggcattttgttatgaaagttgaactcaaatatattagtcttatatttgatttttatatatatttgaattttcagaaaatggttaatgtctgtggttagagatttgtttgttctgcagatgtattagtaatcctctactttattaaacagtttaaacagaattgtcattggcctcttgacctcatattgctcagttatataatatcttggggagaaatacactttatacacttttctggggagataagatcccattattcacgtatgtatacgtatgcatgtatcttttttctttttgcaatgaatattactctgtatcctgacaaagctaatagccatatcctcctacttggagatttgagaagcatgagtgttggacgtgatcctcaagatctactatgtacaactccaagatctaagtgttttcttgaatgagaactcagactctcacttttggcagactttacttggagatgagagattcttgaaattgggcttttggtgtctgtaatattactggaaaggaaagaatagggataatgagataaatgacatggagagattctctccttagattgttaaagagaactttcactacaatctatttaccacttcctcgcttttatttcaatatgtgccatggtctttcagtcaaaagaatttctagttaatggaaagggaactgtgaactttgttaatattgttcagttcccttttatatagcactccttctctttatcaggcttgtcttttactgtagtcatttctgaccagaaacaaatcaggaaattatctatatatggagtaacagaagtacctgaaggagcccttctagtgtgtgtgtcttcttaaataagatgcatgggttatatctgattaagttccttctaatttaatgaaagcgcatttactatactattggacatatttggacatcttacatttttattttattttattgaaacagagtcctgctctgttggaggctggagtgcagttgctcaatctcagctcactggaacctctgccttctggattcaagtgattatcaggcctcagcctccccagtagctgggattacaggtgagcaccaccatgcctggctaatttctttttgtatttttagtagagacagggtttcatcatgttggccaggctggtctcgaactactggcctcaagtgatctgcctgcctcggcctcccaaagtgctgggattacaggtgtgagccactgcacctggcctatttatacttttcaaaatgtgcttttatatattatttattcattttatgaaaatcatcacgcatgatgcatagcataatgctattctatgtgaaaaagtgcttattaatcattagattaaggcaaattaaaatcacaagatgaaccactaattgcccagaagagcgaccagaatttaccgagagatttattactatgtgttgacaaagatgcagaacgaatgaaattccagtcatacacgggggaacgtaaatttatacaaccactttgaaaacattttgggaaatctacataaagtattccttatgacccactaatccactcctaaatatacatcctacataaatacattctcttttttatttgtagaaatggggttccactatgttgcccaagctggtctcaaatccctgggctcaagcaatctgcccgcctcggccttccaaagtagtggaattacaggctgcattcatatattaattaaaatatgtatacaacagtacaacattcttcataccattactgttcatagtataccaaaatttaagttaagaagtttatctccagtagaatgcctaaataagttgtgatatattcatgcaaataaattttatgaagcaaagaaaaataatgaactctcactacatgcaacaaaatgaaagaatatcaaacatcactttaagaaatgaatctggacaaaacttattcttaaagaatatttaatatggaataatattaaatattaacaacagacaagttctattctatctaaagatttttcttcttttaccccacttttttctttacctctttcaatgtatctaaagattatgtcacacacaaagacctggaccttccctgtctcgtcttccctatctccgcaatgtaacagaagtctaaaccactgcaggaagattgagaaacatagcttcccttaaggtactggtaaaaatttattccagctcatagacaggaacaagaaattaaaaggtgggaaatagcataaatacatgttagattaagacctagaaccgaaggcagagcaagatcactgagaaagtcccatttacaagtcccagagatacagtgtctgcctataacagaggcttaatcagaactgtttcttctatctgtgtatatgtttgtgtaattatttagcctgatcatagaaaatacaatttttttaataatatagaatattctgtaaaccaaataatcataaattaaatcaaaaggaaaatagtagtaaattccacagtgttaaaatacacacaagatctatattatgatcttaaagtcttttatataatatatatgtgtgtttatgtgtgtgtgtgtatatatatatgtatgtatataaagattccatatatatatatatggcttcctcatctatttgatactaaaagtcctatataaatattttctatattgagtatgtttctacctaggttttctagcatctattttaacttttaactttacaattttggttcctgtacatttggtacatagctatttataagttttaatttttcattgcaaattttgatagcattaagttgtcacattgaaagttgttgatttaaattatactgactttcttatcagattctcagatccttctttcttaatgtctccatctttctagcataattttgtccttctctttacttgcagtctttctgaattattttgctttaggtgtctttttttatatacaggacatagctgggaattatatttgagcttataaaaatattttttatcttttaataggtaagttaagacctttcacatttattttataaatggtgcatgaattgaacttctctaatataactaataagtacaaaaaagatactcaacatcatagtcattgagattattttaattaaaaccacaattacatgccactataagctcaatacagcagctacaataaaaaacatagacaatagtatttgttgttaaggttatggaaaaatgggaattttaatgcattctaggtaagcatgtaaaataatacagccactttgaaaaatagtttgttttcttaaaaataaataaataaacataaatgtaccagaaaatccaggaatccctttcctaagtatctacctaaaagaaataaaaatatttttatacaaagacttaaactcatatatacatgatagcattatttataatagctaaaaaggtaaaacaatccaaatcttgatcaactctttaatgaatatcaaaatgtgaactattcatacattgaaatgctaatcagaaaaataataaataatgaaatactgatttatattacaatatggataaatattggaaatattatgccaagttaaaagacacactaaaaactacatattgtataattccatatatatggaacattcagaggcagaacattagagagaggtaattgatttcttggtactagggtagatggtgaaattaattgtaaaccagcacaaggcatccttttggagtaatgatagtgttcaaaaactaaattatggtgacagttgaggaacacaataaatatactaaaattcattgaaagttacaaatgggagaatgttacatgggagaattttatggtatacagattatgtctcaataaagttgttgaaagtactgaggaatataaaagttataaaattgccaaagtacttttcaaaaaagaataaaatgagatttacattatctgtatccaaatgtgctataagtatgtagggatcaagaaagtatattagtgtatggtgagataaataaatatctacaacaatgcaacagaatgagagtccagaagtagataacacatatatggtcaattgatttttgacaaaggtggtaagatcattcaaaagattcaaggataatcttttccacaaatagtgtttaaatttttggaatttaggggcaaaaaatatgaacttcaaacccacattacactgtacataaaaattaactcaaaatggattactgacctacctaaatgtaagctgaaattataaaacttctagaagtagtcatataaaaaaatttaatgaccttgtgttagacaagtatttcttaacacgtggcatcaaaaaaagaaacattaaaaaatgacaaactggatttattaaaattaaaaatgttgttcttccaaggagacaacaaaattaaaatataagccatagactggcagaaattatatttgcaaaacgtatatgtgataaaggatttgtatcaaaaagaactcttacaactcatcaagtagacagactatccaatgaaatcattgtacaatgagcagatgattcactaaagaagatacttggctggaaactaatgatagtaaaagatgctcaaggccaggtgcagtggctcatgtctataaatacagcactttgggaggccaatacaggaggataacttggggtcagtagttcaagatcagcctgggcaacatagagagaccacatctccgcagacaattttaaaaattagctgggcagtgatgtgtgcctgtagtcccagctacttggaaggctgaggtgggaggataccttgagcccaggagtttgaggttacagtgagctatggtcttgccactgcactccagcctggttgacagagagagatcctccctcaaaaaaaaaaaaaagttcaacatcattaatcactagtaatatataagcaaattaacccacaataagctattactatacactaaaaaatagaaaagcttatgtaataaaggttgaaaatactaaatgtcagtgaggatgtagaggaattagaactcttaccaagatgctggtggcaatgtaaaatggtacagtcactttttaaagaagtattttgacaggttcttaaatgattaaaatccactaaataattcagtactttcaccccaagtaactacccacaataaatgaaagatatgtgggttaatttgaacagaaatataaatcacagttgctaaaattgggaacaattaagatacacatcatctggtgtttggataaataaaacgtggtgtatacaaggtatgaaaaaccactcagctaaaaaagaatggaagatggccaaacagatgcaaccggaaagctccattcctgctgaaagagaccaaaatattgagtaaaccatatagctaacagacactataaagcaactatacaatcaactctacaaaacaaccagctgacagcatgatgacaggatcaaaatctcacatatcaatacaaatcctaaatgtaaatgatctaaattccacaattaaaaggcacagagtggcaaaccgaataagaagacaagacccaagtgtatttggtcttgagagatccatctcacatataatgacatccacaggctcaaagtaaaggatggagaaagatctaccatgcaaataaaaacaaaaaaatgcaggagcatctattcttacataagataaaaaagactttaaaccaaaaacaattaagaagagcattacaaaatgataaagtttcaattgaacaagaaggcttaagtaccatggtaccatatctatgtatcctttatgtaatgatatttctcagcctgttctgtcttgctaattatggctatactgtagcatatttttgttgggtctatagcttttgattttaataatttttacatgtttattcatttaattatttacatatttcttgaatatctctcatatcatcagactgtttcttattcctataatgaatgagaagaactatcactggcattccctttttgtaatttacaaacttgaaaaaaagacccaagttctgttaggagttttatagaggaaatgtatgagccattcttgacatctgagacctcgtctagttcagaaaggtgggaactggtgaagggaaaggtttatccagatgaaggcagggaatagagaattttaggctgacactgagttttaaataagggctatctggaaggcaacttgtctgtgctttaatttgactcagttagctgggttttcatgctcatgtattctttcacctctagtacgctttgataacaagttaaaagaacatgcatcctatacaatataataagagacgttacatctattcaaataaaatagaaatgacaaatgttcattatcaacactttaaaaaatgatacgataaatatatatccaggaggtaaaatgaagtaaaaggtaatgagatatgactgattttccccattaagaaagtaaccagaataggagcctcctctgctattagaattcccaaggccttggtcaggtttgtgacctgtccctgattatttagatccgtggcaaatgaaaggtctgagaggaaaatagaagatgcgtgagaggaaactacaaatgagggaactttgggcaacattaacaaagctcactatcccacattcataatccaggaacacccctagccagccttggggccttggaatatagtgaggtaacagtggggaggtagagaagagactgaaatggtcatccactttgagacacaggagtagaaagataccctcagagtcaagtcgcatgtcattcctctttgtccaggcttctctgcaaagtcctataacccaattacaagagtctttcacatccacctcccagtaatgtttgccagagctgaggatctgagctccccatgaagaagtatactgtgtacttgttggattacaggacatgtctgtatcatcaaggctgcactgcaaatgccttaggtcttcgaacagaagcttgtgattactgcatatcttacgatccaaggtgatatacactatggcaaaagaaaacagtgaatgcaaaaaaacagtttaaaagtttggaggtacaggtgcagaggcagtctggcaaatgcttaacaaccaatccctgaaaacaaacaaacaaaagcaactggttttgtttattaggaatatttccacctcactaaggccagtttcaagctaccaacaatttaataatcagtcaaaaaatttcaaaacatttaacaatttgctctcatgagtcagtactaactgggtccggcataccactctatcacgagtggcatacagagtatatcagagtaattatggagacagtttagcaacagcttcttgtccatttgcagggcaaatgaatctttaatcaagcaactaagatgaaagaaaatttagagaaaacagagatgtaggatgtcaagctctgatttaatttttactagactactaaaaatttgccagcttattcataagatgccaagaaaacatcaaaatgggcctttatttaagcctccttattaaccaattttcgcaaaataaaaaaacatactaaaaataataaaaatattattaattatacttaagctatgacactgttatcattattagtcctaaacaataccactttgcctaagatgggagggcttcacacttgatcttagccaaaaggccaagaagtaatgagggcttcacaacttaagcaagcaaaagtgaaataaactgaaaatctatatgtgcctttttaaaaaggtggtttctctcccagaatttctggtttggacaccattaaatcagaattctcttcatctcatcccatggctgcctctcttctatatgccagactcaccctccatttccattcgtctgcatagccctctacacagtgaagggattttctttcagactgctttgtggttgtacctattgtttacaaacttgtttttctgcttttgagaatcctgtggtttttcaaatgtattccttaaaacttcaatctttaggtaaacattcgaataacaacattaagatatttctaagaattggatcgtgtaaatataaccagagttgaaatgctttgaatgaatatgcagttttatatgctacactgaaaaatgaatgctttatttatagcattcctccaggtcttttttgagtgtttttttttaatcacttaaaataatcatgttacgcactgtatttcttatttatttattccagacttcagttagcttttcctgaaagtttattaacagttttaaaattggttataaaggtttccatatttacctgcttgttcactgaaaataataatagagacagagaagtgaatatagactaaactgaatataggtcacccatataaaaatacttacgttggaaacattagtgcagttcacactcttacctctgaagaagttaagcctttctgacaccccagtgatggtccatgcactgagctgtgggttcacaggctgaggcatggccagcctcagaaactcattcctgcaaagaaaaatacctacttttaattaccagtcccaaaggaatcattagcaatccactaataagatgcttgatcagaatcctcacaattaggttgaagagtgtgacttgaactcaagaactaagaaatattgcaattgtaactgtattttacaatgtgctctgctgcttttaatacctctatgacagtaaagtatgttatcccagtcataattatatcagttctcaccttcacagcttccctaggtgagccatgcagaaatactcatttaatttctgaaatctgatagctgtcaaatttttggaacatgccacctgctacatatggagcctcagctctatactacattccttcttggtgatgttccctttctcttattttcaccatctttccatcagctgcctctctgagattatttgcctttcccattgacaacctggaataaccttcaaataattaggatgtagaaaattagaggcaggaaaaatagttgccttattgaaacttctacattaggccttgcaattaaaactgcttcccatccttcactttcatctgaagtagtcaatatataaagcctggatgacctttgataagaaaggaataaatacagacagaaattcctcactaaaagtgtgggtcgatcccagcagaaacagcctgattattgtcacaattaccaggacttggatagaggggcaaacttaccttttcattacgtctcccaaatcctataaagagagagaggattgcttagtttgcagcacaacatggttctctcaatatatcctagacatgcagtctgaggatatggactgaattggaaaacttaacgtcttccactttccttctttggataaaggcatttttcattttctttttctttataaatatgaaacccagtctgacgtctacatgtagtcaataaaattatactcttgatgaaacatagtcagatggactgaggttgaacaaatgggaagaggaagggaagacattctactgtacaaacatctgcaacaagattgacagaggtccccacaaagttcttataaggatgtgtggggcccaaatttaggacttcaaaactaaaagagtaaataaatttcataaatctcacactttcacatattgacacatccttatacaaaactgaatcatgtattcatgagctgctctgttgcaactactaagaatcagtgggtgtagtaagataattttagaagagaattttcctgaatttgttactagaacttttccaaatagttttccttctcctctatgggacaagaaagagtgagaccgggtctacagaggagtgaaacctgccaccataaggccaggaaaggcagaatctgaatatttggaaccggaaaagtaatatagatcaaaaaggatatagactctagcagatacgattcccaagcagggtggtgttcagcaccctgatctccttcagtttttacctgaggcaggttcacatctgctttacagctcatttccttcagtttctcatacatttctctcaggagtatacccatcttagccattctagtttgacttctcttgagttgctgaaaaattatcctgccttctcttgccaggctctctacgtgcttttgctcttcttcacggaggtattgacacaccttaggatattcagcactgatcatcatgctccgcaaatttataaaaacctgtagtgatagttgattaattaaatcatgtgtctaagtggttttattctttccttatcagctattctgctttgtttcatgttttgtgctattctactaaatatagtttaatgcttttccacttcaaatacagtataaatcttcctttcttcctccttcccttcctcttccgtttccctgcatcactccatctactttccctcaaacctccatatttacattttaaaaataaagataataaagataaattaagatcaaatttatgttgtcttatataatgttctaacctcttcatcattatacctaaattttattccatttttctcaatactcctactcacaacaatttacttcctcaggaaaatagagaacataagacattgctgcatctttctaaattacttccatttccaaaacactcggtgcttttaccagtgtttggctatgcttgcctattacctaagactacacatctctatccaccccttctctagattactttcttacaatgttcattctttccttctgcctgcgtctgtcttcctgtctctgtccctattgtttgcctactctctctttctggctccatttctctgtctcattctttccctggcttgtctttgattttctgtctctgtctttctgtcactgtgtctttatttcccccatctctctttcactcaattatattattattattattattattattattattattattattattattattgagacaaggtctcagtttgtcacccaggctggagtatggtggtgcaatcatggctcactgcagccttgaattcctgggctcaggagatccttcctcctcagcctcttgagtagctgcgacttcagacacatgccgccatgccaggctactcaattactttttttttttttttttttttttgagacggagtctccctctgtcacccaggctggagtgcagtggcatgatctcagctcactgcaacctctgcctcccgggttcaagtgattctcctgcctcagcctgcgtcctaagtagctgggactacaggcgcacaccaccatgcccagctaatttttgtatttttagtagagacagggtttcaccacattggccaagatggtctcaatctcttgacctcgtgatccgcccacctcggcctcccaaagtcctgggattacaggcatgagccatcgcgccggacctcaattactttttcacagtttttcccttctttccataccacctttaaatacgtgcaaattttgcaaattactttggaaaaaaaattaaaatattcttgtcccaattacttcatctagcttctcttgctaaaacatttctatccttattaaagctaaattaatcaaatgtgatcaaacttgctgtgctcatgtgtgtgattaaagacccctttacctctattccctactctttcctgaaccaaacattacaacttaccaagaacttttttctaaatccaaatattatgctttagtcctagaagtcttcaccttccttctgcatttgacaccattttctacttattccttttaaccataccttgtttttcctgccacagaaaaatacattcttacaaagccactgattcatttcttctgcactttcttatccctgaaaatgggttcttcttggccagcatagattctacaaacctggattctttgtatccattctctgctttatttttccctgaagcacttcacgaacattatttattataaagtttacattttaatttgtagattgaattcccccactagattatagactcctagggtaagcgatctatttcttcttttgttcacttctgtatcattttgttgggctacagcagtaagcaacacatgataggccctcacgagaatgcaggactcctcagaaaatccatctgaaatgatcaacatgatttttttgttcccctttggcattctcacagtatcacatatcaattattattattctctactggtccctgtttatatgtccccttcagaagtgcttgagatctttgagaataaaaatgttgtttaatttacttattcagttttaggtacttaattcatatttgtgaatggattatataatcctaaattcttacctaagcattcacattctagacctggccataagtacatttatagccatatctctcaccactgcctgactctttttcatgaattaatcaagaggagttactcacatgcccaaataattttaccgcttttctaactttcagctttcttattcctaaaatcttccaacattatcatcggtaaatttctaaattttactaacacattagcatcagattgattttcacctagaagctatttttttttagcatttcatgtctgctaacctgctgtagaaccacatttttaccttcattctagtgatcttacatgccacttttagcacatttcttgtcactgctgatgtattattggtagatactgctttattcagaaaaatcaggatatttttagttatatattggattcaacatgaaatctcacactaaagattaagttatattgtagagaaacacatgtaggtcctttttctgatcatcctattcaggggacacatggttaactcaagttcttctcccacaagtcacattttctattccaaactggttctgagagaaatgagcttactgcttacttcccatgttccgattatgttggtctctctgtttagatttctttgatttttctgtttttttttccagatggacttcatttgaatcaggagtttcttctgaaaaacaaaactataaatctgagcactagaaaagaaaatatagtatatttcagatactaccaaaagaggtacagacatgggacaagtaaagagtgcagaatgcagacatgcaggggcttttcttaagggcactgattgtcaagtccgagaggtcaatgaaaccaaaggtagaattcccaaatttagaaaacaagacccattatcttagaagtctggcactgaaactgatacaaccttgtcaattttcagaagtaactcttattttatatttaattttaaaatgctagccctcaacttatctacagtactattggagcatactgaccagtatttattagaattttctataatagattcattgcaatcatgactgtgttagccaatgactatcatggaaactagtgattaatatagagcttcttacactgaaataccagaaccctaatgctcatcaactttatcatcattcttctccctcagcccaagagaatttaaatttcaggtgagcagggatgtttggtttcttcagtgctttatcttagtgtctagaacagtgtctaatttatggtcataagcaattctgtttgtttattgcataaaattattaataacaataatgataagtatatctttccgtattacctgtaggattcagggttcttcacatttcaaagtgcaatcagtagcatttacttaccctatagtattcatcagcctcccttgtcatatagtgtttgtgagtagcatgccttggggattgagagcatagaaaacacagcaggctcctatcagtttcacagatgaggttcttgatttcctggtgtctcctacagatcagcatggcagagcttgataactggcaggggactgattctcttgtaggaataacttgtttctcagcaaaaataatgcgtttgaagtacatttgctgtgatatttccctgcacacagggcagcaattaggagttagtgtatcttcccacaagaggcagagacagggactacaaaatctgtgcccacaacaaatggtgacagggtctgtcaaatagtctgtgcagatcgagcaggtgagctcactggtagaacactgcgtgatagcagaagccatgtttctgaggaaataaaaggaaagtgtcattctttcccccatggcatatgaaatgagcttaagacctttttttactaatttgtgtatgcattgtagcatgacaggccatgttttctgaaagactaaaataggatggagagacacaaacagtgcaacagattgatcacatgtcctctttcttgacaaccttggcctatagcactattttccagttccctaatagaaatccaatatttttcatatctgttatctctcctacaaaaacataaaaattacaagtcctgggctcatctgtagccacaggcagtggatcattattttgtccaaagctatcaagatttccccctttttttctctctctcttattggtcatcataagacacgtactccaattctggccaagagaacaagaaagtagactcgtagaagaattctgtaaaaggtgttcttgctacagaagagacacatagaagaaacaattgctttttctgcctctggacattatttggatgcaatatttgtttgtgtaaccactttgtggactcatagtgaactaatctaagaccaaagccaatactctaaggaaaacagaaaagtggaaagaaactgcatccttaataatacaatagaacactacgtaattctggagaggccaactaatgcaatagaaggaatggtggacaatcatcattttactgatgccataaaaataactgaatcaggcaagaatcattaatggataataaaataactaagtcatagattttgtgaaagagcctatttacatatcatcaaagttctaccccacatgtcagctctatccacagtgttattgaggcataatagataagtgaaagtgtataatttaatgtatacaaacagaggtagatgactaaggacacaaaacacctctgtagtatttttgccaaaaacattttacctgcatgtaaccatgggaggaaattagataaatgcatttgaaaaacactatgcaaaaaataaaactggcctattaaaataattttaatttctaaggagaaaatgtctggaaacagctatatagcaaagataactaaaagaaataaaaaatctaactatgatgtaattatagtatcattgatttgtacctggtttgaaaaaagtaacagccgattaggacatttttagaacgttcagggatatcataaaacctagtagagtcttatggttgcagctcagaaatggagaaggttgaaaatactattgccacctccctgcaagaaaaaaagtccgagagaaactaaagattaatgaggtttagtttgtttgtttgctttgtaaaccattagagaacagaggtaacaagacaactcaatcagttctggatagagacaggtacagcactgagaaaaacaggacccatgcatatgtttatctggggcagattctaccaaaggccataaaaacagaaaataaaccaaatgattttaatttactgctaaaaatcaaagctgggctagagtgagtgtgcaaagacccttagggtcacagacatagaagaatcctcacccaaagggagacttttccaacagaaatgccaagaggctctcacagggaaaaccaggaagaatcaagagaaattttcccttcttgtggtactggccggaagagaaaaatggcagcaaacacatgaaatcaactgaaatatccatcaatgatagaccaggtcaagaaaatgtggtacatatacaccatggaatactatgcagccatgaaaaggaacgagacaatgtccttcacagggacatgggtggagttgaaagccattatcctcagcaaactgcaggatacagaagaccaaacaccacatgttctcacttataagtggaagctgagtgatgaaaacacatgaatacatggtgggggacaacacacactggggtctgtcaagggtaggggttggaaggagggaaagcatcaggaagaatagctaataaatgctgggcttaatgcctcggtgatgggatgatctgtgcagcaaaccaccatggcacacgtttacctatgtaacaaacctgcacatcctgcacatgtactcctgaacttaaacgctgaagaagaaaaaatacattttaaaacatcttttaattcctagaagctttgctcaccatgcattttccccaagcactatattaaactgaaagtgatttcacaccagatctctttcttccagtctctgcctttctcaatacacataaaagcaccctctgcagtgaatctgatgatattttgtttaattttcttaatgtttctcccactgaaacacaacatttaaaataatttataccaactatgttaacgaatattaacataatagtgacaaagactagttatgtatcatgtattaaaataatttaatgtaatttatttttatgttatttttcattttgaaagttttttacaagtagcaaaaatacatgtgcacagttgaattgggagaataaaagtagacaggtatctgtatagtaaccataggcttttgaattaacagtaacaaaactttttaacataaaaagtccagaacctgttaaggcactcaggaggggggtctccaggtgcagagagtggttctcattccagttctattccttcaaaagatttctggataaccactgccaccatcaaggtggccacaaatggggcttttccacattaatatgcttgctgaactcagcttcaatttattctgaaacataggaaagagatgcgactggacctttggttaaaggctttattaaaggctccgtaaaaactacggagaaagaaaagcaaacagtaaccagaagtcaggtagcctagttcatgaagctcacttttctcaccttacagttggtgcttctcctcaaggaacctactttgtcttatcctgcctgccccaccacacagaactgatgctttgtagctgcccgcactgtccagatccaggaagaggaggagacgggagagggctaaagtcttcattaccagctgtgctttgtttgctctctgagaagggatcgttctcagattaacagcgaggctaatgagttagcctagctggtgcatcagtatcacctgaaaagcttctgaggccacagattgctggggattacccatggctactcttcattcagtaggtctggggtggggccagagactttgagtgttaggcaacttataagagattgctgctggtccctgaaccatactttgtgaacctctgatttagcccaatgttcataaaagatgatatgtttatgttgtacaaggatggacaatttaaaaaaatctatttggaaagcacgaaaatagaagtccaggatgtaaacctgccactgtagcttcttaagaatggtaggaaatgcatccccttttgcccatacaaccacagcaccgtgggaaggctactgtgcaggactcttgcttttcagggtctaggagctcaaggaacaagatatagacccaatgtgcagggtcccaggcagccctagttttagacagttcctttccttaccccaaccttacaaccagtaggtgatcaggaaatgggcccttactacagaggttcacaatgtgtggctgtgattatttttagggttcataaagtcaaaactatttttataataataatactatttagacattaattgccctttgaaattttattatcccatgagtatacaggagattttcccaggggctacatgacatgaaatatcacaaaagattgaatagagaagcagatgtgagaatccagatgacttctactaagccagacattaaagtgatttgtaaatatgtaatcaaagccactcttttatttatttttatggttttggaaagtatacttatttttatagaaatattacattaccagttattgttttataattgttaaattattaataaatagatatttgtttttcagctttaatttctaatacagcatatcttgacattaaaaaacccacatcaacaaaagcttgtggagactcttaatttcatcagcttaactgaggtataatttacataccataaaatttacttaatgtatagagtttaaagacgttaataaattgctgttaaattcattttatgcatgatcaccatatccacttttagaacactttaattctttcaaaaacatctcttctccccctgcttttttttttatacttaagttctagggtacatgtgcacaacatgcaggtttgttacatatgtatacatgtgccatgttggtgtgctgcacccgttaactcgtcatttacattaggtatatctcctaatgctatccctccccactccccctaccccaggacaggccctggtgtgtgatgctccccaccctgtgaccaagtgttctcattgttcacttcccacctatgagtgagaacatgtagtgtttggttttctgtccttgcgatagtttgctcagaatgatggtttccagcttcatccatgtccctacaaaggacatgaactcatccttttttatggctgcatagtattcaatggtgcacacatatgtttattgtggcactcttctccccttttatagtcaatctctactcacatccctgtcttcaaggaactgctgctctgtttcttgtctgtaagatttttgtttttgttgttgctatttttgttgttgctttctaaagaagagtcttgctttgttgcccatgctggcatgcagtggcactatcacagctcactgtagcctcaacctcctgggcgcaagcagttttccctcatctttctgcatagtttgtacttcaagcaaacaccaccacacccagctagtttttaatttcttgtagagacaggcactctgtttcccaagctggtctcacactcttgggcttaagtgatcctcttgccttggcctcccaaactgctgggattacaggtgtgaggcaccccacctgacctgtctatagcgttttgacttttaataaatattacacatgtaatcattcaatatataatcctttgtgtcatttaatatgtttttgagattcatcatgattttatgtatctatgatttgttctttttttaacttttatattttataatttcaacttttatttcagattcagggagtaaatgtgcacgttctttacatgggtatattgtgtgatgctgaggtttggggtacgaatgattccatcacacagatagtgatcaatttatgtatgtctgaatcagtgcctggaactttaaatagactcttataaatgtctgtggattatattatttaaaacgagcagccgttaaaaattcacttttactgaaaacatttcatgaaatagcccctttgataaaatatttctaaattgacccttacattttcttacctttccttctacaaccaactctacagccttccatcatgtctactccatttaattgtttaagtcaccatccacttcaacgttgttacgtacaataccctatctctaacctccttttaatcactctcttttcaataatactattggttacttatttcttcttgatttcattttattcttataacttcatattctgaaaacactcatttttattagattctcagacaaaatttatattcatctgacttccagcctacctcagagaacaccctttagcagactttttggaagtctccttcttctctgtttcatatccaactattagactgtccaagtgctcagttttgctacctttccctccttgattatgctcaaaattagtgtcatatggtgtgatgctttaattaatatctgataatgttacccaaagttatgcttcactgatgtattcatctattcaatatttactcactaaatgtgagtgcaaggcattgttctagattctaaactgttcagtaaaaattataggggcccttgttttggaccaagctcctgtgctaggccccaacagagcaggctaaaaaccaaaatgaagtttcccatactgaagttctacatcaccaaaccaaaactaagtgttggttgttgggttgatttctgactgtcctattaatagaaatcagaagatagagattatgtaaattcccaaatagggtagtttcagtcggcatgatattggggttctctctgttttaatgtttaccccaaaaagtaacctgaagtattctgatattaaccaatcagttatttttctgtactctttctccctgtccctgccttacaaggaacataactttaactttgagatgatcagccagttttccgttcattgtttttgctttcttcagctctgtatataaaaccaagcttttctcagcttataagaatacttactctattttatgaaatacagtgttgccaacttctggaatcacagataaagccaattaggatctttaaattaatggttgtcactttggttttttaacagaaccaaacaaatgtaatatatattatggagtagtaaactatttttttgttttgttttgttttgagacagagtctcgctctgtcgcccaggctagagtgcagtggcacaagctccgctcactgcaagctccgcctcccgggttcacgccattctcctgcctcagcctcctgagtagctgggactacaggcgcccgccaccaagcctggctaattttttgtatttttagtagagacgggatttcaccacgttagccaagatggtctcgatctcctgacctggtgatctgcccacctcggcctcccaaagtgccaggattacaggcgtgagcccctgcgctcggccatggagtagtaaactaatatttgggctccagattcttatatgcactgggataggtaatgggcatttcaaaaattagaactcccaacttccctgacaaaacctgcttacctttttctaaatgtcaaaataactaggaatgatctggatttctcttgtacttttactttccatttcaggaaattatcttgcttttacctccaaaatatgtgcaaattgtccagtttccttactttttgtgtattaagtaccattactgagcacatgaaataatttgctgccaagagaactttcttctatctgtcttcatttgtctcccgttctcccatgaaagaatccaatagagcaaaaggcagaggaaagaggaattcaacctttttatttttccctgccttactggtaagctaagacgtgtcataccatctcttgccattgcactaggatttacattattagctgccctggatttcaggccttcagattcagactaaattacaccattagctttttccagagcttcttgtttagagatgataggattgtagagccaatttctcattataaaatcacattctctctcacacatacacatgctcacacacacacatgctcattcacacacacacacacacacacacagtcccctattgctgctgtttctctggagaattttgacaaataccttaaggaaaatttacattgatacataataaaagagatttgacaaaaatgaatacacattacggaataaaactgattaatccaaatcggcattttattaatatgttatgatttcaaatattagcataattgttacagttgtaagtggtgtaacaattagcttaaaaattagaagcaatacaaaaacatataactgctattatttaatattgctctgtattttctaaaagaacacataaataaaaagggatttgaagtattaaaaatataaatattgccattattttctggtacagtttacctagaacatcacttataatttgctaagaaatctaggaacaaaaacactaaaatcaatggatataaaatggatgccacttcttctatgatgcaaacgttaatgagaacatgaaaacagaggaaagtatgagagggcagtagccttcaactgactttaaaagatagcagtaaaccaaaataattaaagctatgtggtactggtgaattcacaggtggaccaggagaacagtatagtgtgcatatctactcctgtatctttctaggtatccatgtatatttctgtatctcctgaatgataaaagtgagatggacttgcacctgaggcagcaggaagaatctggagcttccacccagcagaataaatacaacagacaccacttggagaagcagtgccctgcccagtcacaaaacattgattctatggagaagtttattcaagtgaaatagataaatttccatgtttaatttcatgtttttgaaatcagtaagaagtctctttgggagctgaatcagatatacatgtaaaaatattgccccctacatcattctgcccacactcaagcatgggaatggccaagtccttacttcagggagtggggagagtgatggcaggagtctggcaacgttcttaaggcacctgccctaactcccaccagctactcttcactctacattcagcacaggagtcctgagggacacttcacaaagaaggtggagattacagactcagtgtccccctaccacctcttgctggcagaaaataaggaaagaaaaacttgttacttctggaatactcagtctaataccccatagcccaatcatctcattgtttattccaaaaacctcaattccatgaactctctctctctggctagttgtgtatatgggtggggaggcaatactggctaatactaatatttgttctctatggttggtccccacttcctgggtttatgaacctaatatagagagtagtgcactgcatcaagttccttgtttataacctgtcccactttgtacagaggaggagggggagaaaggagggaagggaaaagtcaaggaagtaaaaaggagcaggaggagggtcccctccctttgacatagataacacagatggacttttggcttggaaggactgtccaaccttttagggtattaaccaggctcaggttgagcctgagtcagaagtaccctgaggaagctgagctagagctgctgccctcagactagccatcttcatcttcactcccactgctagagtcggagtagttactactttcatcctctttccatcttccttcttgttttcctaatccctatgagtaattatacttgacccaaatggtttctaatgaatttgttcctggagccagcagcctctgctcctcttcaaattcttctttcagactccattctgatgggatggcagatctttctatcaaacctggtgtttgggcctcctgtgatgctcgtgttcttgtgctaattagaagttgactgtctatgcagcataatttttttgagacagacaattgagccagagattcaggtctatcttgcagtatttcagcaactcctcagcctggctcttatgttccttaaggctctgcagaatatactgatggtatctgccaatctctgtcatggtcttactcaatggcacctgttgcagcttcctactcaatcatgaatcttgatgatacttttggaatccattcatgaggggcttcttgggctctccatggaattgtatctttatggaagagtcatagttttctggttgagatctcaattgcacaaatttctgaggccttattgatgcccttctaatccatctaggccagaatgctttctgaaatgcaaatatgctcgtatccctatcctgcttaaccttattacgggtttttgataaactacaggaaagtacttacactcctctggatgtcttctacgccctatgtgatgtatttcgtgctcaatgtatggattgttcttcccacaaatcccttggattctagaaacactgagttctttgtatttctttaacatgccacaatcttctgtacttgttttttatcttgaataacatgattactttgccagtgggaatacaaataaataaaatcactttgaaacagcttggcattgtaaaattgaagatgcacaaactttacaacacagacattcaacctataggtagatactgtctggaaggagaatctcttgaatatttgcattaggatacatgttcacagaagcaaaatatagaaaacattccaaatatacaccagcagaaaatgaataaatacattttattattcaccagttatccaaatttgggttatccactccaaactcccacttgattgtctacataaatagatctgggcccattaaatagatcttctttgtcacgtgttaatgatgttaaactttgtgagtagaaggcattggagagatgtttcaagaaggtgcttttcaatctgctttctgtgtgcacccttggcaaactctggcaatgcaaatgacatctccagcatctgacacggagggcatacagagctacaccagtgcccagattctgtagttcaggctgctgctatggcacccacttcctgaagttcatggtggccaggagaacccagcggccaagagcttctcctgaaactgtcctttgccaaatttgtagtagagcccctctggcttgacatttcttcataaacagctttacacagtggcccagaagacaagtttctggggagttctgaagtgtcaatttgaagcagattctccaagggtaacactacagcgacttcttaacattgagcgaggccacaatgtgaggggactcttcattggctgctccaaattcaccatggagacgagcaattccttatatctgctcatcacatattcttgagacttctctttacatattactagacaatatttcattgttccaatgctgtaacaattaataattctttatattaactttccctattcacattactgtatgttttctctgtcttgatggaccctgaatcctaccctcatgtgaatgaatgctctatatcagcaaaatatggcaaactacatccacagtgataatatatttgaacccttaaaagtcaatgaaaaaaatcaagtccctgaaaattacacatggtatgattgtctttataaaaattcaaaaatacataatgccaaaacatgtaaaggatacagccatgtgtgataaaattataaataatgacagaggaaagataaataaacataaaattcaagaaaatgcaaaagcgtaactgtcattagtacatggggcatccaaagatattagaaatgttattttcttcatatggctattaggttcacaaatgttcatttaattactatacatataagttatacgatagccttttatataaataaaaagaaattaattatttcttatgctatagagtgataacatttactaaaagtgtcatttgatccatttcccaaatagtgtgctgagatagtgatcctctcagcccagggtggccaggcaggccatgaggcctctggcttgggataatcttgtgcatattccccagtgtgctctctgacatactgatgttttcttctgtgtgaagtgacatgaatagattagacttgattcgctgataatgccagatgagagttttactatattaggccattctccttagatttaatactgagttaaatgtttccacttcagaataacctcttataattatgaaatttatttttaatccatagggagaagataaacaatataaacacacacatatataaacactcacataactatatataatattcaactttatttcaaatataccaattttaaaatttatcaatatacccattattattctttgagtgacataccacacaaattcaatacagagtctctaaagaatcctcttaggctacttcactcaaagtctctgcagctgcctgcactgtgaaggctgcaacagaaatctgtctcttcacatctccccaggccttggaagggtccactttgctttcaatatcaaacagagcatcataaattcctgggaatgactcccctgcatacttgttgtggctgcttggagcatagatgacatgcctgttgataaaatcgtttgctgtttattaggtgcccaaatgatatacaagagaaaccagagcactctgcaattcctggattgcatattcctataacaatttgaacaagccacttgtcaactgaacttccaagttcaatcatctctgaagactattatatgaaatctatagtaattaattatattttatttcaaacaaataaattaaagtggttcagtactacaaaactaacaatgatgatagtaaccacagcaatcattcttggtatttagtgtttacttacaatttttctgatgtttagaaataaactctacacagttgatattagtatttcacagaggaagaaactgaggtctgaaagataaagtaactaaatgatttgtctcaaggcacatgacaagtaactgctgattttttagtatatcatgctaccccctacattacagcacaattatgatcgttacagtcttgtttgtgatcagtaaaccctctattgtatttttttgtctttttttaaaaagtcacactaccatgttagaatacttaatatagagtttgaagaatcatcaaaaacaatttcgtaatgttccacgtgaccaaggcagaaaatgttttatagaatgggctaagacagttcatgtaatagcccacagaagagaaagacaaactccaaagtaaagatgtaaataaggccagaagcagtagctcatgcctgtaatcccatatattagggaggccaaagtgggaggattgcttgaggccaggagttctagacgagcctgggcaacatagggacaccctgttgctacaaacgaaaatacaaatattagctgggcatggtggcatgtgactgtagtcctagcttcttgggaggctgccgcaggaagattggttgagcccaaaagtctgaggctgcagtgagctacaattgcacaactgaactccagcctgggagacagaataggaccctatctcttagaaaaaaaaagggggtgggggatggataaaaatatgccgccattggtgatctgatcgagtcaacctatttggaagatgttcttactcccaagcccaaccctttgataatccctagaaagaaagttagggccatttctggctgtccagtgatctgtcacattctgcaatatttagaagatcaacctcgggacagtcaatgtttgacagaaaaaatccaactgtcaggatttaggaggaaataaaatatctaaatatcaacattagggaaaagaataaataaatatatatttattatatacattatatatagagagatgtttgggttgtgtgtatacataagtaaaaatatatttaagatagaaaaggagctaaaattatacacacaagaatataacaatgattttatatttttctgataaaattggggagatttttattttctgtcgtggctttctggatcttctatattttctaaaataaatttatattcttttataatcagaacaaagatattcaaaataaagatatgcaaaaatcatattacattatatgaagaaacaatacaactatcacttactacatatattttgaaattttctatttgcttgcaagaagtcaacttcaatattttttccacagtgaaaaaaataaaaataattagcagaaaaagtgatattacagaagggagtcatatttccttttcttacctataaaaaggtctgtctggtaaccctaatggatcaataaatgctctttccagaaacatgagttgatcattcatcattcttaacaatattgggctgagaaagaaaatgaatacaattataacttcatgaaaatgtttctacccagaaaataaaaatgtcagaacaaaactgaatttagttatctccggggattggttccaggaccaccctctacaccaaaatttgtgcatactcaagtcctgcaaggaggacgcatgtatatgaaaagtcggccctcctcctctgtggaatttttttttattgttatactttaagttcgagggtacatgtgcacaacgtgcaggtttgttacatatatatacatgtgccatgttggtgtgctgcacccgttatctcactcataggtgggaactgaacaatgagaacacttggacacagggtggggaacatcgcacaccggggcctgtcgtggggtggggtgaggggggagggatagcattaggagatatacctaatgtaaatgacgagtcctctgtggaattaacagggtgaaaatgaacaaactaccaaacaaattaaatagatctctcggtataatgatctagatttaagtctaaaagttacctaaaattatatcatttcaagtgattttcagaatggttaaagtacagcattcttggagcctgatatgactttctggattaacttggtctgcctcaatgaggaaatgtagctgtgtatgtggcatctgaagccacatctgatctcccttgggttagctgcccccagtataactcttaccacatgcttaatccccctttcacatcttagtcttcatattgttaagacaatgagataggcaattatataaaatagaaaatgtttatggaacacatggctagtagtccaaatggaatgtaacaggtttttttttaagtttctataattctcttattttatatttttcattagtttctcattagctacatctgaggttctcagattcaagcttgtagagtgagcatcattctgtgataaatgttctaatatatcaaagctaaaagaaagatgtttgttgagatgttttccacataaatgaatttactcacttaaaatacttttgttctagatttatgtccatcctacttttagatgtttttaatgaaatcattttctgcatgcaatgctaatattttcaaatgtaagcttgaaaataaaagatttaatttggcaaaataaaaagttttccatatttaaaaataacaagaatagtcggccctccatacatatgggttttagtccttcaatactgtattttattttgttttcttaagagattttcttgctctgttgcccagcctggagtgcagtggcttaatcatagctcagtatagcctcaaacacctgagctcaagcaatccctctgcctcagcttcctgagtacctgggattacagtgaataatactgaattttccatctgcgtttgcttgctaatatgaaatctatggatagagagggctcactgtattaattgaaaaaaattcatatgtaagtggacctgtgcagttcaaatcactgttgttcaaatgtcaattgtaaattttaacattctgtaatatgcaaattaagaacaataacatacatagctatgacatctttaaaatcttataaaatactatactgctcaggcttataaaagcacagaaacagttgtatgtgcaaatggaaaaaataacagtgatttttatttacattggcataattaactgatcaacccagatatacaaatataggcaagattttcttcaccttaggtatcctagcaatctactcactgaagtaatatcaatattaaaataagatgacttgctaatgtttagtaagatgcctggcaaattataaatatttaccaagcgataactaacaatattccttttatttttaaagctaaacctattatgaacacaagagatggtgattacttaagtctttcaacaatatttggatacctcctatttatcaaacactccctgcttttacagaacttacattctaaaaggagtgttggggttgttattataataagaatgtttcaatataattgaaagtttatcagcaagctctgaatacttcaacaatgagttactgaatttaatataccaattatttcacaatttaattaactgagaaaaatcattacaataagaaagcatgaatcatcttattcattaatttacttcttgcttttcataatttggttttactaaaagttagcatttagtgatcatttcctatatgccaattactgttctgaatgtttatacaaaatgtgatttttaattttcagagcaattctgcaagttgggtagggtaacagcctcattttgtagatgagataacaaaggatcatgagttaaataacttgcctaaattcacactaggaagttttagagtgaaataggagattgatattgttctttcgactgcaccttgccaacaaaaggaaaataggaacaacttaaactcccataatttggatttgagctatttttaacatttatgtatttggcatcatgaattcagattctgtgatattataaaggtaaatgaaacacagactacctgttagcaactccgataaacagttgagacaattgaatgaaggataatttcaataagatgctatgggttttggaatcaaattcacaaagcattgctacaagtacaaaaactcatgtggctacacacatgtaaatgtgtgcgcgcgcgcacacacacacacacacacgcacttctctttctctgtatcctgtgttaacgtcttatattctttgatgaggcaagaagtgatacaagaaaagcaggataaagacatatctcttccttagatttcaaagttttggttgagaaattcaacattcagtttaatttacttagtcagaatttactattattatgggcaaagcactactcaggtgtttcagaatttgtaaatatcatatagggaacagagtggatctttactatcacttagagaaaataaaagaaatatagaaatactaaaggaaggggaagctgagtgtgctaaacaataagtgtcctaaacaaaccacaattcaaaccatgaggtattttgtcagagggagaaaacattttttcttttaaatacaaaaagaaaaccagttttatagaatacatggtgtttgggatctccttaaaatgtatttcttattgttgacttttttacccatatataaaaattataaagaattgaaaagaataggaaaacaattcttccaatattccctgaggatagcacaattattataataattcattaattccctttaagtttttcctgtatttgttaaataaaaattaatcaaattatatttacaattttacaaccttcttgcttactacatattttattctaagtatcttctattatgttgtatttctaataatccattgtaaggattataaaatgttcaaattggtgaatatcaaattttttagtaatttctcttctcttaggcattaggttattttgaattacttgctattataattttatacttcaagtctttctccaggcagcctttcttttccaaaattgagactttttcctaagaaataatccaagaaatggaaatactatgtcaaagcacaggactctgtgacagctcttgaacacattagcaatatgtatctatctttttcaaaaaggctaaaataattcataatgctatcagaaaagcatggagagcatatgcttcagtgtaccagctacagcatgggcacaaccaaggtttaaattgttattaatgtgttataaaaataacatcacattactttcatttgtatttctgaattatgcattagtgaactgcaatattttgctatgtttccttacaggtgtatattgtcttgtttcttaccaatattttcagctggttcttttggactgtttaaattaattttcaaaaaatatttttagaatgtatatattactctccatttttgctagaaaataagttttcaactttcttaatttttcttgtgaatattaattttcgtattctgaaccatttcaaatggtctcaagtctgattgcatcatttccccattgcttctaaacttggcatctttcaagaaatttccatttttactaaataattctttacacctgttgtttatgttagcatacaatgtgaagtgcgattctgaatttacttttatagcaggtactaacatagtttatatattattatggttgagtaatctttccccattaatttttgctgtatcgtttattactaatacttccttatagatcactgagcctatttctacatcatctactgtaatgtttttatgtgtccttacatcagctcctggggatttgatatttatatcatgatactatatttaatacacagatctgtgccctcaaaattatactttaaaaaaattaccttagtattctcaccaagtatttttccttccatcttaaaattttgttcaaattgtgttgtacttgtgtaatcttacacagaattaatcctaaatgtttaacatttccaaaattaatggcttcacaatatttgctattctggataaacagaattttgccagatggaagtggaaataaggagctctatgtggaggtaatgacaaaaacaaaagaggtagaaagaaatcatgctttgaaaaataaatagtctggctgagttatgatgtacagatactgaaaaagcaagaaataaaactggaaacagctggggtcacacagtagaggaccttcaatgttaagcagagtattttgtaactgatcaaatggcaggagggagggactgacatttctgagcagcacaattgccactcagaatgttgaaagtaggtcttttgagatacggcagccctacataggatgtgctagagtggaaagacagaaaacagcaggaaacgacacttgtatacctatgtaacaaacctgcacgttctgcccatgcatcccggaacttaaagtaaaacaaatttaaaaaaaagaaaacagcaagaaattcccaaagctagttcagcaacagtgatgttagtttactttttaaatatatatatatatatatatatatatatatatatatatatatacacacacacacatatacacatatgtacatatatgtagaacatacttgcttttgtcaaagtcctggagtctctcgctgaacttggaagcaatttctgtaaaattttttactgcagaaaaaagtgaatctgaaatagaaattgggatcatcaaatgcttaaagaacataatttctaatggcattgctctatagttcaagaaaaggaacaatacagaagctatcatcttttgtgttttataaggtatttatatttttatattataagatgtgagcattcataaaatggaaaatacatttatagacataaacagaatattggatcacttgaaatagcaataaataataaatgacctaagatagtccattatatttaggagattaatagaaccatacagatgaggaatttgaaaaaggaagggtaacataccaaatgataaactgtatgtcttcatttcctgtggatgtttcatagaaatattgtagattttgtcagcatactttcttaaaactacagcataatctcgacaatcaaaagggagcactatggaattggctagctcaaacaccatccctcctcgaacctgggccacagtgaggtgatatttaaacattggatcataaaacttttccaccaactcatatgtttcatagacactgtgatacagtggatagccgctgaatttgtttgtttcctacagaaaaaataacaaaacatatctcttataggatagcttacaaaaaaatgattagcaccatatttactattagtattagtaagattggccagtgatggatcaaggaaagtacttaagcatctcaataagctacatcctaaacgggtaatattatgatacgtaaacacactccaggcttgtatcaattaaaatatgtgtatatgatataacaaatattatttaaaaattatttgaaagggaccaaactggcttgcctctaagaatgcagaagattgcattcttagattcatgttttaagaatctgaaaaaaaagacaagacatcttgcatttggataaaaataagaagatgaattgttaaaggcaagtacataagtattacacaatattatataggagaagacactaaattgtttaatcactaaaattccatgggtaaatgattgtctgacaagtagtgtgctgaaggctggagagtctgagtggtgaggggtgcagtagtggatccaaaatctcgctaaggagagagaagggaggcccagacaggtgtcaggaaaaccaaaagtataggtagaaggaaggacttttcaaactgtgaattgctggtttatcacttttgatcatcttaagatgcttattttttattattaatataaaaggacattttatgtactgatgtgttgaagagactgggattctgtaattaccctgccagggtttgaatctaggcttcaggacttactaccaaaaactttaggtggtcatttgacttttctttgttgtaattttttcgtagtaaaatgtagacaatattaatatttatcctcactatcacctcctacataactctgcctaacttcctacctcacaaacaggagattgaagattttccgtctgggaagaacagcccatgaggaaaggcttacagaaacttaatgtcaactctaaatcaccaaatgtcttttctgtatttggagttgagctcgatctcttattattgcaatattcttattggaatagttttgaatgaactcttccttgccatttttataactgtgagaatgatttttctttgtaacataaaatttaaaattgaagaagtatcaggattaaaatattacttataaatatggatgtatcataaaagttgacaaaggtttcatctgatgaacagaaatcaggggtggtatgaatatgaaatggaaataagaaacaactgtttttaattataaaccagtgttcttataaaactacttgacattttataaactatgtacccaatttactttgaagaaaatgaaaaccatatatatatatatgtaatcaacaacaaaagaaagggaatcatgacttttacacgtacacagtgtattatactgatatgatttgactctgtgtccccacccaaatctcaccttgaattatgataatccccacgtgtcatgggagagaccttgtaggaggtaattgaatcatgggggacgagttttcctgcactgctctcgtgatagtgaataagtctcatgtgagctgatggttttataaagggaagttcccctgcatatgctctcttgcctgctgccatgcaagatgtaactttgctcctcattcaccttcagccgtgattgtgaggcctccccagccataggaaactgtgagtcaattaaacatatttcctttgtaaatgacccagtctcgggtatgtctttattaggagcaggaaaacagactaatatatataacatttttcatttgtttaatgacttgttatttgtttaataattggagatacagtaagagatggaaatccaaatacactcattaattttgaatgacaatggggagatactgactaattttgaataaggaggagggtgaaatcaaagacaattcctacatttccaacttaaatgactgagtgaatgcaatgccaccaaatgaaacagaaaatatgtttaaaggagtacacggaagttcacatttgcagacatgagtattgataccaactgacacttgaatttagggttggaataccagatacaggagttatcctacgtagtagtgatactgtcaaccattgagacttctccctctgctttcaaatttctctattcctctaatgcttgagtcactttttggagtcagaattatttgtttagttaaaacatattcataaataatcttggataatttgagattcacttacccaatttttagtataccgtgctctgcctgaagcaattccaagtcgttggaagaacacctcaaaatcatttccagatcccaatttgcttatccttttagagataaaacaacagaattatttcannnnnnnnnnnnnnnnnnnntattttcaaaacgatcccacactgaatttagtggaaacttcattcatttatttacctgggcatgccactgaactctggggaaggactttttttagtccaactttcataaagagatttgccttcaaagccttcatcagggcttttcagctacacaaattaaaagaaaaaaagagaatacttacaaatcagatatattaaaaactagatgtccattaacgagaagtgagtaactaagccacaattcagcaaaaacaagggatgctatccatacattagcagtcatcaagaattataagtttctgacaagtgggaaaatactcatgtggttatatataggtgaactatattataaaaataaatgtatgaagtgcatagcataaacaggctacaccaaattcataccaagccattgtctttagatgaatggcatagtgtatgatctttttgtctatttttctgaattaaaagatactacaatcaaaactatttctcatctcacaacaaagaaaataaaaagaagcaaactggttaaggggaaggattcaatttaatattgtttcttgccagtagggttaccaaagtcattcaataacatacaataaaccgcaatgtctgttcttgtaccagtatcatgctgttttggttactgtagcctcatagtatagtttgatgtctccagctttgttctttttgcttaggattgccttggttatatgggctcttttatggatccatatgaattttaaaacagatttttcaaattctgtgaagaatgccaataatagtttaataggaatagcactgaatctataaattactttgggcaatatggccattttaatgatattgattcttcctatgagcatggaatgtttttccatttgaatatgtcatctctgatttcttagggcagtggtttgtagttctccttgtagagatctttcacctcctgagttagctgtattcataggtattttattcattttgtggtaattgtgaatgagtgttaatttgtgacttggctcttggcttgtctgttgttggtgtataggaatgctagcaatttttgcacattgattttgtatcctgagactgataaagttgcttatcagcttaaggagcttttgggctttgacaatggaatttcctagatatagaatcatgtcatctgcaaacagggatagtttgacctcctctctttttatttgaatgagctttattttttttgtcttgcctgattactctggccagcacttccaatactatgttgaataggagtgattagagaagaatccttattttgtgtcggttttgaaaaggactggttatagctttggcccattcagtacaatgttggctgtgggtttgtcatatatggctcttattattttgaggtttgctccttcaatacctagtttattgatagcttttaacatgaagagatattcaatgttattgaaagcttttttctgcatttattgagataatcatgtggtttttgtttctagttctgcctatgtgattaactgcatttattgatttgcatatgttgaatcaaacttgcatccctgggatgaagcctacttgattgtggtggataaactttctaatgtgctgctggattctgtttgccagtattttattgaggatttttgcatcattgttcatcatagatactggcctgaatttttgttgctgttgtatctctgccaagttttggtattgggatgatgctggactcatagaattagttagggaggagtctctcctcctaattatttggaaatagtttcaatagaaatagtaccagcccttctttgtacctctggtagaattaagctgtgaatccatttggtcctcggcttttttttggttggtaagctatttattactgcctcagtttcagaacttatgattggcctgttcagggattcaatttctttctggttcagccttcggaaggtgtatgtttccaggaatttatccttttttctctttttccttttctttttttttttttctgtttttgttttgttttttgatgaagtcttgcactgtcgcctgggctagagggcaattgtgccatctctgctcactgcaacctcgttcacgcaattatcctgcttcagcctcccgagtagctgggattacaggcacctgccaccacacccagctaatttccatttcttctagattctttagtttatgtgcatagaggtgtttacaatgttctctgatgtttgtatttctgtggggtcagtgggaatattcccccttatcatttctgacagtgtttatttgaatcttatcacttttcttctttattagtctagctagcactctatttttttttttttccaaaaaatcagctcctggattcattaatattttgaagggtttttcatgtctccaacaccttcagttcagctgtggtcttggttattttgtgtcttctgctagctttggggtttgtttacttttgttctctagtatatttagttttgacactaggttgttaacttgagatctttctaactttttttttttttttttgagacggagtctctctctgttgtccaggctggagtgccgtgacgtgatctcagctcactgcaacctccacctcctgggttcaagcgattctcctgcctcagcctcccgagtagctgggactacaggcacccgccaccacatctggctaattttttgtaattttagtagagatggggtttcactgtgtttgccaggatggtctcaatctcctgaccttgtgatctgccctcctcggcctcccaaagtgctgggattacaggagtgagccaccacacctggccagatatttctaacttttaatgtgggcatttagtgctataaatttcccttttaattctgccttagctgtgtcccagagattctggtgtgtcatatctttgttctcattagtttcaaagaacttcttgattcctgcttttatctcattatatacccacaagtcattcaggagcaggttattcaatttccatggaattgaatagttttgagtgaatttctttctcttgattttgaatttgcatggcagtacaagagacgtttttaatttcatttctcttgcttttgctgaggagtgttttacttccaattatgtgatcaattttagagtaagtgccatgagctgatgacaagaatgtctattctgttgtttctgggtggagaattttgtagatatctatcaggtccatttgatccagtactcagtttaggccatgaatatctttgttattttatgtcttgaaaattaattaatattttcaataggctgttaaagtctaccattattattgtgtgggagtctaagtctctttgaaggtctctgagaacttgccttatgaatctgggtgctcctgtgttatgtgcatatatatttaggacagtaagctcttcttgttgaattgaatcctttactgttatgtgatgcccttctttgtcttttttttaatctttgttggtttaaagtctgttttgtcagaaactagaattgcaactcctgcatttttctgttttctatttgcttgatagactttccttcatctatttattttgacttatgtgtgtcattgcatatgagaagggtctcttgaagacaggataccaataggtcctggttctttatccagcttgccactctatgtattttaattggtgtatttagcccatttgcatataagattagaattgaaatgtgtggatttgatcctgtcatcatgatgttagctggttattctgcagacttatgtgattgctttatagtatcactggtctgtgtacttcagtgtgtttttgttgtggctggtgacagtctttcctgcccatatttagtacttctgtcaataactcttgttaagacaggtctggtggtaacaaattccctcagcatttgcttgtcttgaaagaatcttatttctccttcacgtataaagctcaatgtggtcggatatgaaattctgaattggaatttcttttttctaagaatgttgaacattggcccctaatctcttctggcttgcagggtttcagctgagaggtccactgttaggctgatgggcttccctttgtaggtaacctggcctttccctctagctgcctttaacattttgtctctcattttgtccttggagaatctgatgagtatgtgtcttggggatgatcttctcaagtagtatcttactgaggttctctgcatttcctgaatttgaatgttggcctatctagctatgttgggaaagttctcatggattatatcctggaatatgttttccaagctggttccattcttcccatctctttcaagtacaccaatcagtcatagattcagtctctttacataatcacatatttcttggaggttttgttcattcctttttctctattcttgtctgcctgtattatttcagaaagacagtcttcaagctctaatattctttccttcacttggtctatactgctattaatacttgtgattgcattgtgaagttgctgtagtatttttcaactctattcttctctaaactggcttattttactgtcagttcctgcaatgttttaacatgatttttagcttcctagaattgggttacaacaagctcctttagttcagtaaactttgtccctatccatattatgaattctacttctgtcatttcaggcatctcagcctcaacccggttctgaacccttgctggagaagtgatgcagtcatttggaggaaagagggcactgtggcattttgagttttcagtgttcttgtactgatcctttctcatctttgtgggcttatctgccttcagtctttgaggttggtgacctttgagtggagcttgttcttttcttttcttttcttttcttttttttaaacagtctagccacttttctgcagggctgctgtgttgtgctgggggctcgactccaatcactagttgcctcagattttacagtacctggaggaatcatcggtgatggctgtgaaacagtaaagaatgcagcctgcttcttactgtgggacctccatccaagggagttatagacatgttgccagcctgaacagacctgtaggaggtggctggagaccccactgggaggtcttacccagacaggaggaaaaggatcagggacccagtttaaaaagtagtctggccacgtttttgtagagcaactgtgctgtggtgagggtccacttcagcccttggttgtcttggacactccgaagtctgaaacctgggatggctaagtcacccaaacagcaaagatggtggtctgcccctcctcctggcagctccatcccagggtgtcctaaaacctctgttagccagagaacaccagtgggggtagccagaaaccctagttgggaggctccacccattgatgaggaacgcagttggggatctgctttataaggaagtctggccacgtttttgtggggccactgtgctgtgctggggtgctgcttccaccccccccccaagtcatcttgggctctccaaagcctaaaggtgggaatggctaagccactcaaacagcaaagatggcagcccacccttccacccccacctccctgccccccaccaccccccaagagctctttcccagataggcacaacactgctaccagtggctggctggaaatccaagccagtgggtcttatcctgtgaggtgctgtggaagtggggcctgcaggccatcactgctcaggcccttgaattcggcctcttttttatgggtatgtatgggggtctaacctcctgctgtgctggagttgcagttacttttgccatgaagcctggaaagctggtgtatctaaagctcctgtgtctccatgcatgcctgagtggctgttctgctaagactccatgcagctgtgtatcagactgaaggccctggtggagtgggttcacgagggtatctgctgacctaagggttgcaaagatccatggaaaaagcatcgtttcctggggttgcacattcgctcatcattttcctgggtgggggaagttctcttgactctgtgtcattcccaggtgggccgtcgtcctgccttgcttttctccattctccttgggttgggttgtttccttgattagtcccaatgtgagtatctgttcatttcagttgaaggtgctgtatttacttgccccttcaatttctctttgtgagagccacacaccatagttgcttctagtcagtcatcttggtcactcctccattccattcttttgcaaccaaagcttaatggcatttaaattttatttataatccctatctgaaaaaatgtaattgtgatctcatctagcctctgtccctggaagccagcacctggtattcttatgaatattctttctcagtcaattggatcatttaatgattcctgtgttctgaattaattggtatcactatactgaagagtataaacaagttttttaattaaggagttgagccataggaccaagtcttggttcggctaccgtacaagttgtgtgtgactttggtggccaatgttctttgagctcagtttcactgttttaagaatggagatggtagacatgatgctactaacgggctacctcacagtggtgtggtgagaaatgaggcaatctgtgtaaacagtttactagatgtgatggtctgtgaagatgtgatgtcatatatgttatatgaaaagaagacaagaagttataaaacaacaccaatgtttaacataataatacctcaagaaaacgtcatttgtagaacttgggttttcctaaattatatgtaattgtatacctcttttgttaggttgtataccaagctgtacatcagtggtgtacaatcaactctcagagtgtagtttcctgaaaaataagaaaagaatagattttaaaatttaatttctttctgttattattttcttcaaagaccactgctaaattcctaccagaatgattgttttaaaacctgatttcaactgtaactctccaatggcttcccaactaactctgtaaagtccatcatcctcaccatggcccacactgccatgtatgaaaccccagctcacctctcaaaaatctgcattttacattctgcccaagaatactccctcagcatctttgcacacactgtccttccagcctggaacagtattctgcattatatctgcatgacttactcctcctcctctggtctaatatcatgtttttctgagagatttcccctgatcaccctacctaaaatagcactctcttaccccctaattttagccactctctcttttaaccttggctcatgtttctccatattactcatctatttaacataaaacatattaagtacttgtctttttattattggccctcccactagaagataagtcccctggggtaaggtgcactctcttgtttgctgccataccccagtgcttagaacaatcctagaatttggtatttaaccaatcaatatttgttgtgacaatgaatttgtgaaccagatgctcttcttagagtttcagtccccattcctcaggagggggctggtggttgcgacaatcaagtgaagcacccaggagaggtgttcttgggaagccaagacagcacagggaggggctgctgactcaggaggagttttgggggagggaagtcaagacaacttcacaaacttggagaggggactcttgaactgggttttctagaatcaggacgcagttggggggaaaaatggtatttgcagctaaaggcatagactgtgcaaatgcccagaaatgtaaaagcacatgaaacactcagaggatggcaactagcttttatcccaaagccccagatccatgtttgagaacagcaaaagttgaggcttttaaaacagtgacaccacaacagaattgtttatggaacttaaagatttgattttagattctaaaatttatctggaagaataaatatgtacaaacagccaatgtaatttttaaaacagaagtgtttataggagtggaaattggggaggggagtagtttggcagcatttattacaatttaattgcccacatcctaagaccaaataaatatacttgtagctctctaccctctcctcacattataccaaaaaagcatgcaaataaaataatattaaccacaacaaactgaagcaatctgtccagcagctagaaaattgatacagaatttgtcctattgattatagtgtagatttttgttgtctggtggtagtgtttgttttttaagtgaaacagagatatgtgctgatatggaaagtttttcataatgtgttgctgaatgaaaaaggcaagctgtagaaccatttagctgtaatatgataccaaatacctgtttaaggtggtgagagacaatagagtgtagtggttagaagggtaaagttggaacagactagtctgatttgagtctaagctcaacccttcactagctgtgtggccttgggaaagttacttaacctctctgagtgtcagtttcttcttttatacaaaagagataataaaaatatttacctacttatctcagagggttattgtgagtactgaataatttttttacgtgtaaagcacctgagatagcacccactatgcttttggtgctttgtgaagctaaattctatatattaatgccaacatgatgggaacacccaaaactgaggacagtaatacctttggagagaggactaagtttgagagtagtttgcattgaggagttttgctttatttgtaaattttacattttaacattagaaatttcagaatctatgattatttgtattatttgagaaagaaaaattaatacaatgtaaaaatataaaacaagtgagatgaatggtgtcccaatcatatagtacctcctgtcctttgttctcgattttgaaaattatagagacacaatgaagcaatttcaagccagggatgacataagtagcaaagcttaatgagtttttaaaatacattaaaatatcaaatcttaaaaaactatggccaagtattgtgccacacacctgttttcccagctacttgggaggctgacgggggaggttcagttgagctcaggagtttgaaactatcctggacaatactacaagatctcatttcaaaacaacaataacaacaacaacaacaacaacaaaaaaaaacagaaaaaaactatcaataaagagaacgttattctacatttcaagaaaatatatttggagtatttattctgggtgggcatataatatacatatatatatatacacatatatatatttcaccttattatgtgttttaagtaggtgtaatgatcctaatcaaagttaactttttttgacatttactctgtgcaaggcacaggtctgggagatttgcaaatgtaactttttttgcccttacaggagcctttgagataggggctcttagaagttatatttagatgtgagaaaactgaggcacagaaagtaaatagcttgggtcacacaaatgggaagttgcagggccaggaatgaatccaggcatctgacgccaaaggtcaagctcttagccactaccctaagagaaggagaaaagaataaccaaatgcactgtgtaaactaactttcagaacagtgtagctcagaggcattgacaaagaagaaaaggaaggttgggagctgtggctcagacccgttatcctagcattttgggagaacaatgtggatagacagcttgagcccaggagtttgagaccaacctgggtaatatggtcaaacgtcatctccactaaaaatacaaaaattagctggacgtctagcgtttgcctgtagtcccagctaccaaggagtctgaggttggtggatcacttgagcctgggaaatcaagactagtgagccatgatcactccatgcactccaacctgggctgcggagtgagaccctgactcaaaacaaacaagcagacaaacaaaagaagaagaacggaaacagaaaaaacaaacaaacaaacaaaaaacagaaaaagaacagaaacaaaaaaagacacaaaaaaaaaacagaaaaagaaaaagaaaatgccaacgtgactccatcaaggtctcatgttccgagtgttgacatggcaaatttactaatacactaaagaaaatattctaaaaaattcccccttcattcatttagtccttttttttttttttgcaaccgtaccacagatatttatttaataagacattaggaatctaggagtgaataagcaagatactgtctgttccttgttaaagaatacagtctattacttgtaaaacaaataattacttaataatgacagtgatgaatgccatgaagacatgtcttccctgaaaaagtaacatttcaacggagggtctaaggataaggattaaacacataaagaggtgttgaagagcaatctgagtgtagagaacaggagtgcaatgactgggatgttgcatatggtcaagatatagatatattagtggagctggattgtagtgacaatggactctttcattttcatgaaaatcaatctgagatttcctttagtttggtcctttgcttattaaacgtatttccattcttcaaagtcagcctcaaatgcctatcccctttctcaagcctttcctgaagtttctattattctttcctctgaactcccagagtggttttatcctaccctttctaaagtacctgcatacattataattcaagattgatttagcatattatctatactgagtgcgccaccacgcccggctaatttttgcatttgtaatagctatggggtttcaccatgttggccaggctggtttcgaaatcctgacctgaagtgatccacccgcttcagcctcccaaagtgctgcgactacaggcgtgagccaccgcaccccacaaatgatactttttttctacaccattctaaattatagaactctttaggtccctgagttaatcattcaacagatacttactaaattcctgctgtatataaaaagaaatctgccagatgaagctaatcaaagaatgctgcttttctgaattagtactctatgctgcaaagcaaagaaaaaaaaaaagtaagaaaagaaagaaaagaaaagagaaaagaaaacaaaaggaaaggaaagaagaaaagaaaaacctgctcacctagggctcacccaactctcaactagggttcacacactgcttcctgtcagaggttgcagtagattccctaaccacacgttaatacatagccttccttgttagtgcataatttattagctagactgctgctcctagtttaatcacatcttttcttatgagaccaacgatattcaccttctatagatgagtcagcattaatataagccacgccacgctcttgaaggagtcttgaattatcctacaataaaaaggaaaactataaatataaagttataaccccctccccctcccccacaaaatgcacatctacatttaatgtatgtagatttctaattgagctgacccatattaatgacaaatttgacataagaaattctcataaaagagctgctttgaaagaatttcaataaagattactggtaggaaacaacaagcaaaacttgttaaaagctaatatttaagatgaaattgtccatatacttatggtaagtggaaaaagagttaatttcttaaccatactgtagtttatccttcaaaaaattgtcttagcaaacatgaatgacctaagagacttttcagtgaaaatcttcctataaacatctcattatttaagcagagaatcttgtctgattcatatggaatgaaggtattttaagtgtatgaaatttcaagttaaatttcatattatgaaaaataagtgaacttaaatcatctcctgaccatgaagtcaggctctcctgtaggatggtaccatctcctggtcaatattgataattgcacacttttagaacaaagcgtagcaaagtttttttgagatatcagtgtgaattctgagtctctaaaatacgtaatttcctaagcattctgactataagataaaaaatgaaaaaaatgcaactgtaagtgaaaaaaataatttgaaagacacaaattacatcatcaaaatattaggttcttccagatagtggcaaaattctttcttataaaactttgactaagtctacaggagcaccatttttttttcaaagaaaattaaagtccacagggtttcacataatatctggagtatgaaaggagccaataaatatttacagcgtgactggaaattaatggaataaacattgactttgcatatatttactttatagctaacatttctgttatataaagccaacaatacatgcaggtaaaattacttttcaaatggcttagtaaatattctgtggtggaaatttttgccttacttttagcataatttaacatagagcaggtcattatgaattaagaaagataaatgaaaagtataccttacggccaggcgtggtgacgcacgcctgtattcctagcactccgggaggccgaggcaggcatatcacttaagctcaggagtttgaggccagcctggccaacacagcaaaaccctgtctctattaaatataaaaaaattagccaggtgtggtggcacatgcctgtaatcccagctactcaggagcctagggcaggagaattgcttgaacccgggatgctgacactgcaatgcgcagaaatcacgtcactgtactccagcctgggcaacagagcgagactctgtatagttagctttaggagatattttggaaagcgtaatagaatcgtgatagaaatcaaacatgatacaggaaaatttggcttcatggtcaggaaatagagacaatttaacttcatatttttcataaatttgaaatagcttaattccctttgaatcagacaagattctccatttaaatgacatgtttatgggaagatattcactgaaaagtctgttaggtcgttcatgtttgctaagacaatattttgaagaataaactacaatatgattaagaaactaactccttgttttgatgtttggtttctagcatatctacttatttactctcatactcccaggaaataaagatcaattaattttgacaattgacattaagtggctctaaaaggttcaaacaaaacttagttctttagcaacagagatttttattgctgatttttgaacaagaatatgttactcagattttggggaaaaaactttgaatactttctcattatattcacttcttatttttacatgcttggcaaataattcctggctacttcattttataaaaatttatattatagcaaattaccaactaacctctgcccactcagtagaaccaagaagaccaaattcttctgcatcccagcttgcaaacaaaattgttcttctaggtctccaccctaaaatgtatgtgtatatataaatgatagaaaaaaaattcataatatacccaggacactaccaagcccagattggggaaaaaaaaaaaagtcattgatggtttgggaagggcaaattgtagtaaaaaatctttacttacataactttctttggtaagattttaaagttgtcaatacaaaatagcacaattacatagaaaaggggggaaatgtgacagtaaaaatcttgcaagatcataaaacattctaataggtttataatgattcgctatgcataggaagtcattggtggtctgcaactgcctagaacaaagaaagaaatttctagatgcatttggtattctgaaagcagatataactgaaagaaaatcctttagaactctttcctgttgttctgacatcaaatgaacaattgttcaatatcagctggtccgtatgatttcactccattctctgccagaattaatcaacaagggctcagttagcaacagcaatgtttgctgttgctgaaaaccacataattcaatagaggggtgatgtgtctcggaggttataaacactgaccttggaattaaggcaagatcttgtttcaaaccctggttctctcactagcagcatgactgagggaaagttattcaaacctactaaacttccatttcttcatctgtatacaaggaacaagagagtaaagatgaagacaccacttgattgtgggaggattagatggaataatgtttagaaagcactgagtagatgcccccaaaattgcgagtagtcaccatcttagtaaatactcatgtgtgcttaagaatgtgtatagtatagctgttaactcgagtcttttgtttttgtcaatagtattattcaaatttcctattattatttatcaacattccacttatttggcatattctataattgtcacagtgatgttttgtatagttaccacaggaatttcctagaaaaatcatgaaacatttttgtaataaaattaaacactacctacttcatgaattatgtaaatttaggtctccattgtttgttttcttcaaatataagatagctgtgtagaaaaaagaactaagtgcctttacattttattttaaatagagacatcatggttttgaggactggtagtcagaaatttcagtttgagccctgattctcttattctgccacatgctagctacataatcctggggaaattacttgattctctaaaccttggttaacttatctgtaacatgagaagataagtaaatatgtcttctccctagttgctatgacttcaaagaagataggacatataaaaacagtttctcaaaaaaaaagtaaatactatgcaaacaacatacattattgtttttattgttgataaaaatatatagattacattttacagccccagacaccttgtttgcagggtcaataaagagaatgaacttcctgctctcaatgtgtaattattattttaaaaagcaaacatttgaactaaattttactttggctttcatatgaagattctaaaatggctaaagtggtgatgttacgagtgtaaacctaatttttgcgagagcacaccagggctcaggatgtgagaacacagattccaaacttttgacagaatcccattagacctaagaccagtatttctccgaatagagcatctatctccttaattactctgcacacgtaatctgaggtctggggttagaagagacggaggaacgtctgcttacagtctctgactaggaagctttggcttataatctaatttcagtgtgttttctctagtgatgtaataacccatcttcatcttcttagttgccaagaacaaccattaacagtataattcctttatttcagattatcacttaatacataaatatcaataatatatgtgttatataaataaatgcaaaaataaataaacaatataattaaccaaccaacattaaaaattgtattggtatttttaccaaacacatgtaatggttgaggtagtatttttatactccctttacagaagactaaactgagactcagataggttggtttttttgctgtttgtttgtattaccttcctttttcagtgttccaaagctcctcacagtttcatgaacaacagctgctccactctgagggtcaataccaccaaacacccatgagtcccggtgacctcccagaatgacatatctgtctagaaagcatagatacaagattatttgtcatttcaggtcaataaaagagaacattgcaaacaactcagtagcatctaaatacaaagcactcatgactcaaaaaaaaaaaaaaggctaggttccccaagatttgtgaaaatatgttatttctgattttaatatgtatttcttctatctgagaaagcatacatgtgataaagcaaatatatattgaaatgtattaccataattataagtactacattaagtaattaagaaagtttaacgttatccttattcacattttttgtgtgaataagagaatactcctctcttacctaacttaccactttcgaatatattcaaaataagagaacatagtggccacataggaagttctccaattcctattctttcttttcagtttttaaggtacagctcaaatattttctccctctattcagtttttagggtacagctcaaatattttctccctctatgcagtttttaaggtacagctcaagtattttctatagaagagggaatttctttgcctacccagctatcaggagtgataaagcattgatcacccttaagcatatggctcccttcacaaactgtcagctctttgcctcgggtctgtgtcttcttttatctccccatttccaatgcttatcacagagctggcacaaaataggtactcagtattattcaatagtagccacttatatattgtttagtactctttagaatatgcaaacaacaaggatatcaatattcttgatctaaaataaatcattagctgcttgtaagaaacatgcaattaatatgtttaatatgcatttaatagtatctgttttggtaagaaatacagaaccaaatagttcataagaaactgagccttcacgaactaagactatgcataaaatgtattaatcagtagatcatctgaacttctatggaaatcatatgtccatatattttatcagtggctttagtggtagaaaataaaactatgcaaaggattatcttaattttctaagagcgtgatattttatatagacgttcatagttatcatgaagatatttctctgtgcaaaaatatggtaaaaaaaaattcagaaaactcagaagaaaacaaatctttccctactctgcttcccttcatcctttaattgaggcctgcacaattgatcattcaccttggtcatttgcccagcctagcaccaaatgttcacttcaccacctgtaccacaatacaaaattatttcatatttatttcttttgtttttaggtgagttccactgattttcttcgtttgtttgtttgtttgtttgtttgttttgattcactttgcactcccagagcttggtagtatccagcacataacagttacttgatcaatatttgctaagcaaacgattcctttacctggttccactgctcctctgagagtacctatcacattgtaaattctcgtcacttcattggtagagtggatgtgcatcttgacttttctaatgcaaaaataaaagacattctttgaaaaaaaacaaaacaaaactggttaacagattaacactataagggttaagggaattttcccctctgcctttgaaggttcaagtctggtaaaacaaactgaaaattgattaacaggagaaaaggcgtacaaacttactaacacaccagtgtatacaggagccaaacaaaatgtgagactcaaaggccaaatggctgaagtttaactagcaccctcttcatagaggagggagaagtgggggagtgcaggtggttttgaggggtggtaaatggttttcaagagagttaaatgggcccaaagagcaggcaatagtttataaataattctctttggaacttgaatggaactagagaacagtcaacagcttgtgacaaagcctgtgcagataaagtgatatgcctcagtcttccttcccactatatgagttcaatcttccctggttaataaaatttcagggaggggaaggaaagtcattgtcttccttctgcaggagcttcagataagggaacttcagagacaaacttacactctgctcttgtggggtgaagtaagaggtcagaattattgattctgaagctgcatctaaggacttttatcctttagttcaaagtgctcagcatgccaaaacaccatactttgggttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttaaaaggttgaaattatacaatcattttattactcatatacttcttttactaatccaaccacaataaaaggaatttagcaatcaataacaaaagtaaatttaggaaattcacaaatatatggaaattaaacaactaactcctaaataaccaacgggtcaaagaagaacttgcaaatacaatttaaaaatgctttgagatgaatgaaaatgaagatgcaacataccaatatttatgagatgcagcaaaagcagtgcttaaaggaaaatacatagctgcaaacacctatatagaaagaatctcaaatcattaagctaagctttcaccttaagaaactggacaaagaaaactaaactaaactcataaagcataagaaaagaaattaaaaagattgaaagagaaataataaaataaatagagaaaatcagtgaaaccaagggtgattctttagaaagatcaacaaaatcagcaaaccattagttaaactgaccaagtttaaaaagtaattactaaaatcaagaatacaagataggacgttactactgactttacctaattcctacttctaccacagtgcctgaaatataaaagtcattctataaatgtttcttgagtgagtgggctgtgagaagccattaaaggtctcccaagcagaggcataagaatgagacaacaccataatcaatagaggtggctactaaatgcttgcgtcgttgagtagagagtaagtagtgtttaccaaagtgtcttttgcatcagacatgaatttgggccctggctctctcacttactctctgaacattggttaaaatgagtatcacaatactaactcatattgttgttttataggttaattgaggagatgtacgtaaagcatttagcacaacagtaattgctaaagcgtaattagcactccatgcaggatacatgctattactgttactgttggcactatagttattgtcctagaagttactgtagaaggcaaattaaaaccacataatcacactgtgttcagtatacatgtaaagaaaaataggaaacaatatatatggtgtcccctttctctcacactcaagtcaacattgaagtttttaccatcactcacatttcatcaactttttatttaagttctcagcattcttgggccattatatgactttatatctctcctcatttactcacacatttattaataaacttttatttcatgatatattccatttgtaaaacactgtcttttctaattagtgcacaatgctaaactgctaaccacttgagagaacctgagaattgagtatcttggcacactcccaaggtacctgtgccaagagagtaaattttcacagtgaaattcataaacaaaccatatgttcttttaaacaattttttaaaactaaatgccacttatatggactgtttcattatggcttagaaagtatgggtggataaatagaaagtgtctatttttaattatgaaattttgaatgtagaatgcacttttccatgaaagttatgttattaacggtgattgtatttgtaaaatggcttacagaggctgacacagtaatgtcagatgaattgtgtttgttatttttcagtcaatcagataattccattacacaatcagagcacagctgatattgacctagtaaaccagaccaaatcttagacgtctaaataaatctcacatctaattccatgacattacgcatccctcttttctaattacaaagataatacaggttcatgttttacattttttttttttttttttgagacggagtctcactctgtcgcccaggctggagtgcagtggcgcgatctcggctcactgcaacctctgcctccctggttgaagtaattatcctgcctcagcctcccacatagctgggactacaggcatgtaccaccatgccccgctaatttttgtatttttagtacagacggggtttcactcaccatgttggccaggatggtctccatctcttgacctcatgatctgctcacctcggcctcccaaagtgctgagattagaagcgtgagccactgcgcccagccccatgttttaattttttatataactgagataatactatatatatatagttttgaaatttgcttttcttcacttaatagtatatcataagcatttttctacattattaattattctggtacaacatataatatcttttaatcacttcatttactatcatagtcattaatgtattatttgagtacatataaattgttcaacaatttattgtctacagttttccactattacaagtaatgccaaaatcacttttatcttttaaatatcatgaatacttagtctttatttatacatatttttaggcaaatgcatagtctatggtgctattaaaagttgtgcccggtcctgaatcttagccaatgcagtaaatcttatagccccaaggaagaaagaccagggtactttcttaatctgcccttaaacagatgtgtcctactccccagatgtcagcctcctcacctctaaaaatgagtgccttgcccttggtcaaaaagtgcttcctcatagatactggaataaaatgattaagaaaggcttgaacttaaagaagaaaagggactacctggccagacgctttggtctctatcaatttcacttttagaaaagccagtgttctctcacctctaaagaataatggtggctgggcgcggtgacacatgcctgtaatcccagcactttgggaggccaaggcgggcggatcacctgaggtcaggagttcgagaccagcctgatcagcatggtgaaaccccatctctactaaaaatacaaaaatcagctgggcatagtggtgggcacctgtaatcccagctactcaggaggctgaggcaggagaatcacttgaacccgggaggcggggtttgcagtgagccgagattacaccattgcactccagcctgggcaacagagtgagactctgtctcaaaaaaaaaaaaaaaaaaaaggacatggcgatgggagaaagcagcacagggaagaggaaacagttccaatgccaggttaagcagaacaaatctgggaaagtttcaataatgaaagcagaaagtttcaataatgaaagcagaaggggaagaagaatagagataaaaacaaaatggaagttgctctcacagtgtgttattctgggtcctcccagacgtagacagtaagaggaatacatgagtaagagatttactagggaaaagcacgtgtggaaaatgagcagagagctaggaaaccctgagaaagtccttagactgcaaggtgggtctaatattgaataaaggaaaaagggagaaggaaaagaaagaggagtgttgggtgtagcatctatttaagccaggctatcagggagtccctgggccaaagttttgcatcagaggagtccagtgccttccagaaacaggcttgtagtagtatccttgccacactgagtcattgcccgagaacacctacagaaagcatagtcttgacacaaatatagtggggtttcaaagcacagtgtctggagcaattgatcaattaggctccctgcagttaaatatctgaaaggctcattttcatggctgtcatacactagacactcatgtatatactaaattccagaacagaaccactcttctattttatagtgataaaattacaagcagcacccatgttggaaaatttaagtactaaaaaatggagataaaagcctaacatttgaaaactgtcattaatgaaaattacccaaatagccatccattgtttcttacaaacttactctaggagcttctgtgcatcatagtatccaactggatgaacaggaatacttggaagaccaacagcctctgcaattccatgcctataagcgtattctgaaaaaaaaaattgccatatttccagtaaaagctcagtttcattcaaacggttctctataaatcacattaaataaattctaatttcacatttgctagaattgttaaagtaaaacagattaacaattcaaatgttagcgagaatgtggagcaactgaaatcctcatacattgcttgtgagaatctagtctaaaattatacaatcacttaaggtaactctttgaaaagcaatgtcaggcagaaatgtgcactatggcacagcaattccactcctgggtactctagaaagatgagcacatgcccacaagaagacgtgtacaaaattgttcataacagccacatttatattagccaaatattagacaaagtccaggtttctaacaacagaagaatgaataaacaatccatagtataatcccacaatggaatgctactcaatcattgaaagaaaaaaactaatacatacaatatgatggaaaatctcaaattagtacattgaaataagcaaggctttaaaaaaaatctactgtttgattccacttacttgaagttcagactcaggcaagtgaatacacgatgctagatattagaaagtgattgcttctaggggacacagagaaaattgaccagaaaggggtataaaagaactttccagagtgatggaaatgcccttacattctattttaagtgacataaacacatgcgatttgcaaaatttattgaactgaaatcttgagatctatgtattttattgcatgtaagctctacctcaaaataagcacacacatcctatcatttcttcagatttaagaaaaatcagagctgtttttccattttttttctctttttaaaactatctaataagaaacttaggtaacttcaaatccttgtttttatgggtaaaatgacataatgacatgttgtgtgggatttgttttcaaattctctagaataatagcaaaaaaaattggagtgataaacaaataaaaaaagattgacaacatgttgacaactgtctctactttcgtatatgttagaattatgccataataaaaagtaaaattagaaggaaaataaaaatgtatagggcacaaaaaatgattcaataaacattagccccatagaaataacataattttccccctaaaataccatcattcaaatttgaagaaaatcaacagaagcatttcagttaatctcattttattttcattattttgactttgcataactaataaagcttaggctaagccgcattttttaaaacttggaaataaaaaggtggagcaaataaagttcaggtagatttatataattttactatagggtaatatgtatcattttttaaaaaagaaaaaaatttctgacaatgtattatgttctaagaagatttacaaagccaaaaaaaattacataatctttacaggagtctacaatttaagagtaaaaccagatgaagacataaatgtcatagataacttggcaaattattttatacaagttttaaaaatttagttagctttaaaccacacaaacttaatgatcacagatttttgtaaacatcatcaaatagttgagcacattcaaaataaattagctccctttgttaatgttttacaggggagcctttcagcataagactagtatgtggactctgtgagccagactgcctgaatttgaatccaactgctcattcagaggaggggtgatcttgggctgacctctagtctcactttcctccctgtcaaataagagataataacaccccctagctttagggttgttaatgcaagtaaattgctggcatttaggaaacactctttgaaagttatctccattatcttacagaaatgaagcaatatgcatttcctgggctctatatcctaaatgggccatttaaaaagtttatggaacttctgctctcctgtcccttacccacactgtgaaatctgtaaatctggggggaatttattcaacagcaaaacctgatctgacctgaactaatttgaaagcaaaatttgacttgagtagacataagtctgtttatattccttattccccgccccccacttactatttagcgtaagtattcatacactctgcagcaaaaatatttatatgctttttccccatattctgtcccagccccctatgtcactgttatgcaagttatggtatatgtgtaacaccataatgttttttaaatagctgaaaagtctaaatttgaaagcccaccaggcccaagtttcaaaataagggggtaagaggcctgaaccaatcactttagagttcaaaattctttcattcttaaatgcaaagagaataaaaaaagacatgcttagtccattgtgccaaaggaaattctttaataaagtctcttttaaatgttaagtttcctgtgatattcaaggattgatcactcaccatttgctgggtaacctggtgtgagagggtctcctgcaccattcagatttaggatatttccacgctggacaccacctccaggaagattccaaccgtctggataggacttcaccccaggagcaaagtagtcagcagggtctgagtagagaatgactcctttggcccctgccagctgggcatttttaacctagaaaacacagtgtctttctttccttattttaaattggttgttccagatttggtaatatcaattttcaatattacacttaaatgagtactagaactttatcttcaaccttttgtcattaggcctacaaaaaaggacatctcagagagaatttcccttttctttttgctactataagctctaaaaatcctcagaacatcagatttggaaatgttcttatttgtggtagtgagtatttgctatttccttccactagcttagaaatataataagcaagtagaccccacaggccaaattcctatttgttctacagtctaaagggcatttttcaaaatttaatttcccactaaagagaaaaatatatttattaacaaatcaaatgacagtaatttttaaattggctatgtgtaaattgttttcactcattatttataacaattcatactacaatttaatttagtaaacatttttgtagaaaatatttaaaacaaagatactgaaagttaataataaacccagtgcatgcttctttgtaggccacagccataacctgtaagcacagaaaaatttgttctgttcactctaaacatctacactgtccaaattccaatgctcaaatttaaccctgggatataacctagtaaatgtgtcctctctgtaaggtgggcatgtcacagaatacaagaaaataatggtattcataaagttttaagaaaatgattctacacatgtaaaacccactataactttttatattgggggagagaaaaaaaagagataatttttaccttaccttatttcctctgaaaactttcctatatctggcaattacaattttcccagagcaattgattttcatgtcccgttccaatttaaagaagtcttcagttcgtgcatagttaacatgcactagatcaccctgttgagatcaggaatgacttaatatgaatcagatataaaacaaggaggtttttctgcatggggactgttgggcatttttgaaagagggaagaggtcagagcacacaggagggtcagaaatgcatgagctccaaagaagagattcaagggaaaaatgaattgaaattgagaatggaattagttgggctagaagcacatgaataaagtaatatttgtttgtatttgtcccatatttagtggctatgaagctgaagctacagaagcatccccccacagaaaagcatatacatatacacattgctgcacgcaacttgaaggggtccagataccctaggctaagaagcccttaatgagaccttttctctcttcagtgtgtgttcacagggagtagcttaatggttcttaacaactaccaagtaaagaaaaaagcacaggtaacatcactgctttacaggtctgatttcaatcattaatgtgattatgtgcaaatcttataacatatttgagtctcaatattctcattggctcaatgatctgctagattaaatcagtgatcttccaaccttttttgctcacctattccctaaattaattttgacaatgtaccccttcatctaaaatttaaaattttttatcatacctttaagtagctgcaaagcatgcaatatctagcttactataaatattaacatttttagaagaaattgtatacaacttttatattgatccaaagcaatttaaatactgtatttatttactattcaacatcatcaattttaaaaattacatgaacatgctcttctttacagtcaaaattttgtcatctctttttttttcttgaacttgtatattgtccatcttcccccacagaattttactctaaagtaaaatgtatttgtgctgggcaccagatgagctgtccagattcatggtcaacgaaggactttttgctccagctgcaggggaggctctctgcagacaatcttcatctgtcagccccttcaaggattgcctcagctgtagacagccccctttctcaaggtcatgtcccttcctagaatgctacacattcagtgactgattgatgtgagggtacagagacctggacatctcagtctaacgtaggaaaattctgagaaactattccagacctccttataggcttaaccaaggttatccttcagctggcattgcagggtgacttctccctctgcccaatccagctctgcttttcacagatgttgatcccaagagaacactccataattatcaactagcattctaaatttcaattcagaatctattaccttaaatatgggtatgcttgaaagtcttttattaatcactgtcaaatttccttgaatcagtatatctatagaagtcaattttttaaaaaaaattatttttgtgacagattgtgttaagaaacagcttcaagagtaagttataattataggccaggcatggtggctcatgcctgtaatcccagcactttgggaggctggagtgcgcggatcacttgaggttgggagttcaagaccagcctggccaacatagtgaaaacccatctctactaaaaacacaaaaatcagctgggcgtggtggcacctgcctgtaatcccagctactcgggggctgaggcacgagaattgcttgaacacgggaggtggaggttgcagtgagccaagatcataccactgcactccagcctgggcgacagagtaagacttggtctcaaaaaaaaaaaaaaaagatagattaagttataattataattactagcagtatcaaattaagtctaacaacatcattgcaattcttataaataatgtataaccataaaatttgattagaaatatatcttttaatgcaatgagtgggacagtgaagtgttatcttaacacatttgttcagtgggtgaacaaattattgctagaatgagacagggatcagcaacaacagttcaatttacatttcttgtttttacagtaagttctgagaaaacttggataggaacgaaagatttgttatggaattgtcactaacttatttaaacttctttcaagttataatctgaaaatcacaaattagtctatcatacaagtgtcttttaatgatattagctggaaactcaattgggtttacccttaattttgctcaattgtaaactatttgaattgctaagaatttgttacccagctatgagaaccattcactatcttaacgttgaaaacaatatttctaattgtctctttttttgaagccccagagatttttacaacacagatatatgcttcatattgacttagaatgggtaggagatgtttttcatttataaaatgagatgaaaatgcttgtaaatagggagcaggacctcacgacaggctagctttcaataccatgaaaaagtgcacagggtgattgatgatctggaaactgatctctttaaaaccacgtcatgcttgcctttggaaagtctttacacaccctagtttgaaacccctgtcccagatgatttccaatatcctattattttattttggttattgttttcctttttgactacatttttcatagcatgtacatgacaaatatatataagatattaaaatagaattgtttccaagttgattctaggattcatttgacaaattggtgaagatccattatgtgttaagcagtgccctatgttaatacaacaaatctctgcccttgaagcaacttacactgcaggtcctccttcagtcacaatgggattaagtcttattaaactcacctaagttgaaaataattatacatctaaagtgtgtttttgacttaggatattttcaatttataatgggtttatccagacataacctcatggtaagttgagaagtgtattgaatgagtatggctattgcaccatcataaagtcaaaaaaatttaagtagccatcttagattgggggtttcctgtaatgtcgatggggtaatacaataatgagcattaaatttaataactaagcaaagcatacattatattaaaaggtgataagtagtacagaaaaaattaaaaagcatttaaatagagtatacaaatggtgaactagagcttaagtgggtgtaatattaaagaaaatgaggaaagtctaattgggaaactgacatttgaatctttgcctctgtaaaaggattacatttagctcttgtatttcttcctaagaccaatgtaatattaatgcactattaatcataacactatatgtctgatttatcattgttagccctctctggagcacacttattctattttaactgtagctacaaagtcattaaccaatgtgatttcagcaaaataatttttttagttaagtatcctactttctttacccttaatataagtaactttgaggagattgtacctttaaatgtctctaaatgtggctgtcttttgatatatcagcaatcctcacaaaacaaactgtgagggagagaaaactgaaaaacatattagcttaaaaatgagagtaaactttgaaaatgaaaacaagtgtgacagatattccctctcagcacttctaaaatacaagttgtcactgttagttagaaaagagctttatttttagacaaagatcttcttatacaacttacactgtaccatccattgttctatgactgtgaataaatagaatcttgcactcttagcccggaattttctttgtttccttaagcttccatctccctaactcttatttatagagatagaattgggaggcaaaaccagtaattctcaaagatggtccttgaaccctcagaaacaatatcacgcttgttacaaatacaaactctcaggctccaccccattaaacttaggaagtggaaactagaatctgtgttttacaagccatccagattattgtgacagacacaaaagcttgagaaccactagatagactatattttatgaacatcgcaaattgctaattttaaatagcataaagcagagtcccatatttcatattccacaggattcagacgtaaattcaaagattactgatcgtgaatttttgttttgttttgttttttgagacggagtctagctctgtcgcccaggctgaagtgcataaatttaatttaaaatagctaaaaaatataaaatatactttaaaaatcttaaatgaatgtgatctattgaagaagttgaagtgtgaagtgtgaaattgaagaacactgaaatgtattgagcagtgaaaagattatgtatacaaaaacaggttggccgggtgcggaggcaggcagatcacctgaggtcaggaggcacgatctcggctcactgcaagctccaactcccgagttcatgccattctcctgcctcagcctcccgagtagctgggactacaggcgcccgccaccactcccggctaatttttttgtatttttagcggagacggggtttcaccctgttaaccaggatggtctcgatctcctgacctcttgatccgccctcctcggcctcccagagtgctgggaatacaggcgtgagccaccgcgcctggcccgtgaaatgttttaaacacacatacggacatacatagttttgaaagaattaacactcccctggctgggttacagatgatccagtgaggaacaccgatcagcaaactcatctgatatttaaacataaacagcaaacccatacaacatgtgtgctctttgtatttagccattgatctggaagagtttaagtctatttgaaggaaataagagacaacgctctttaaaactctttcttacgattaatagtaatgtcaaagtccaaaaattatttggaagattataattgggcatgtagtaaacctacaaactaatctaggtgtaattttctccttataatatgatgtcttctcatccagaaacataaacggtttaactgttttttgttttgttttgttttagttttctgagatggagtctcgctctgtcacctaggctggagggcagtggctcaatctcagctcactgcaagctccacctcccgggttcacgccattctcctgcctcagcctcctgaatagctgggactacaggtgtgtgtcaccgcatctggctaattattttgtatttttaatagggatggggtttccccatgttggccagtctgatctcgaactcctgacctcaggtgatctgcctgcctccacaaccggccaacctgtttttttatacatagtcttttcactgctcaacacattttagtgttcttcaatttcacacttcacacttcaacttcttcagtagatcacattcatttaagatttttaaagtatattttatactgtttagctattttaaattaaatttattcattatactttctgctatcatatactatttggtcatttatgtttagcttcaatctgataatattaatactatttttaaagaaaactgtattgttaatttttggtatacataagtcatgcagttatatcactgtaaataataaagaaggagaatattaataaagaaggcccaaagtgcaaaaacataaggaaaataatttgacaatatcaaaattaagaatctcttttcaacaaaggaaaacacagagtgaacaaaaaagatgaaaaattagaataggcaaaactaatttatggtggcaaaaatgtcaaagaaacatatcctctggggtatgtagagttgattaagaagaagcataagggaactttcagaagtgaaggtaatattctgtacattgatggcatttcgatcacccggatgtaggcatttgtcaaaaatcaataaatgtgcattcgggatttgtgcatctcattgcagtaaattgtatctttaaaaataccattaataaaatataatcaatattccttcttcttactaagacattctcattacttaaatgtggaaaaaatgaattggattacatcaaaagtccctttatgaccctttaattattggctgaacatatgaagagaaggaaggcttctttttgtcatttttatttgttgcactgtgtttttacctctggcattccttgaggagagaaagcactgaaagatggtacaatatccgaaacattttcatatcctggaggaggtggttcaaataatgatgtgttgaaaatctagagaaacaaaatattataatcaaaataaatcagttaaagtttgattattataatcaaacacaaaaaaatgaatattatattttatgtcagtagagggtgaatgaatccttcaggattttgatgatagtatcagatacccagcactatgctagaagttgtgaagaattcatgagatgaataaatcacagattctgtcctcaaaatggtaagatctattcaaggaaacaaagctaaaaaaccccaccaataactaaaaatcaaccaaacaaaaaacaacaaccataaaataagtactatagaaagaaaagctcagaggaggtaaaaagatactcttccaaaaggaatactgtgtactgtaaactgcgtactgatagaaggaagaattagaaattgatttttttgtaagtggcatacatactaagctagtgtaaataaaagcctaaatatgtagttgcttcacagaaggttagaagtaaattaacctcatgaatttcttgagagaacttgtaaggactagcttttgattttggagaaagattttaattaccaaataaaaagtacctttgtttggtaatctcaatcattataatagtgcttagataattacctaggaacaaattaaatattaaatttacttaaaaaaaaagtatatgattggggaatccacaactgaccatatctagattctctgaacaacatatgcactgaaaagaatgaaaaacactgaaccaaatatatgtctttttaagtttataattaaattggaaaaaaatagtaaggaatgttcagaagcaaaaaaataaaatgaaagcaagaatcctcagaggtagcacgaaagttggctttgccttagatggatctatcaaagcctatggccccatgaaaaggattcaggagttggtttaaagctggttcacataatggaatctagcagaagactgtgcataaagctggtctaagaacaacaatatcctggccaggcgccgtggctcaagcctgtaatcccagcactttgggagcccaaggtgggtggatcacgcggtcaggagtttgagaccagcctgaccaacatggtgaaaccccgtctctactaaaaatacaaaaattagctgggcccacgtgcttataatccgttactcaggaggctgagacaggagaatcacttgaacccggcaggcaagcttgcagtgagtggagatcgtgccactgcattccagcctgggtgacaaaaaaaaaaagaacaacaatatctttcagggttaaggataaattcaaaataaacttgctccatggaaagtaatggtttagcgtaaagcaggaaaaaagggttccagataattcataaccctacaaatttccattcactgtttatatagtatgcctcaagctaaaatatttattttaaagcagtgccaggtttgtagtgctccctggcgcctaagagaaatgatcaggaggaatcagccttcaaattagccttaaagaattcccaaattcttattactatcatattaataaacatatttatcaagtttatgaaacaagactgaattaaaattatgcatataaattggtaatatataacaaaagtgaaagtgttctaaggtttctgtattgtagaaatattgattgaattatgacaccaaagctataggggaaaaaaggaagagtaaaattcacactagaggaaggtaaaagtgacctaaatattgtatattagaattataaaaaatgaaaatggaaaaaagaataattaaaaagcgtagcatgtctaaataaaatcagctgtgtaccaattgacaagcagtgacataaacctactgaaaaagaaataccaaacaaatattaatttaaaaaaaattttaggacaaagtcaaataacattatgacgagataaaaaaggctactacataagtataagtctgtcatttcatcaactattctaattttgtttgtatatgttaataggtctccaaattatacataacacaaatttatggaattataaattttatacatatagtatgaagcagacattactatagtgaggtgagataatttaacatttatctctaattaataaaggaagcagacaaaatgagagagcacattaaggataatggagatttcagccaaataataagcaaactcaaactaatgtacaaatataaaatattaaaccaaacaaccatcaaatacatgtttttcccaaagaaacacagaacatttataaaaattgagcacatattaggttccaaaggaagcctcaacaattgtcaaaggattagtgtcctacaaaccacattatctgatctcaatatgttcaatttagagatcagatcaaacaaataataataacaatctttacattcaggattttaaaaaatcttgtaaacagttccaggatcaaagaagaaaatacagaaattaaaaaatatttacatactaatgataattaaactactcctaatccaaatttgtgagatgtagttgaagtggaaagggaagttaaaggggaaatttatggctctaaatgctcatagtagaaatgaagaaagactgaatgtcaataagttaagcattctactgaggattttacaaagaacagcaaagtaaacacaaagaagataaaagaggcaattataaaacaagaacagaattaataaaatataaagcaaagatagatgagaaaagattgccaaagccaaagtttattctttggatacactagtaaattcgacatatacctctcaagagcaataagaaaaaaaatatagcaaaagcacaaataaataatattaattatcaaaaagaggcacatctgcagatgctgaacagatttaaaaagataagaaaatactaggaacaactatactataaatttgaaagcttacatgaaatggaaaatgcattttaaataaaacttatgaaaactgacataagaatacattttttaaaaaatcggccacacacaatggctcacgcctgtaatcccagcactttggcaggccgaggcgggtggattacgagttcaggagttcgagaccagcctggccaacatagtggaaccaggtctctactaaaaatacaaaaattagccgggtgcggtggcacgtgcctgtagtcccagctacttgggaggctgaggcgggagaattgcttgaacctgggaggcggaggttgcagtgagctgagaccatgccattacactccagcctgggtgacagagtaagacttggtcaaaaacaacaaaaaaatctagttgtatagccatataacaataaagtcatatatcaaacaataaaaattgttctatgacataaaattatcatatgacaaacaataaagtcatttaacaaacaataaaaattgttatatgacataaaatagtcatataacaaccaataaagaaattaaaccagtagtttaaaattttccacaaacagagtcaaggccaactggttttccttgagtttgaaaggttaaaggaaaaaataatttaattacaacaaaaccaatttcagaaaatattaaaaacccaactcattttagaaggcaagtaggatattgaaattataacccaacaaatagatttcaaaaatacagactaaacatgctatgaggataaacataatatatatcaatatatgaatttaaaaccctaatgctaatattacaagttcaaaaaatgtaagattattctaacattagaatatcactgaatgtcatcttcagatcaagaaagaaaaatctcctgctcatctcaaaagaaaaatgtgtttaatataaatccatatagcaaaaaattttagtatatgtggaaaggatgtactttaagataaccagaaaaagaaaacagtaaatatcataattaatggtgagaaagaattaaaggtatttccttcaagaccagaagaaagttaaggatatctgctatcaaaacttcttttcaacattatattgtataggtcttggccagagcagtaatacaaatgggagggatttggagatgaggagggtatctgggcagatcttacattgtactgactagagcagtagttatttcccttttctgacactgatagaagctaaaatgaaaccaaatcaactacgacttgccacatccccacatattccaaatttcccatatttttttctgtgattcacataagaaatgaactcatctgaatcactaggtaagattaaaagaaaaattatgctgaggtgcaataaaaatcaataaaggaagaaagtcattatataagcatgtctttcaggcaagggaatattcaaacttgtctcacttgatttgcctttatggtaatcaatttcgcagcaccactatgccacactgaattttacagcaagtttatgagctattctaacaagtaagaaaagtttttaatgtcaaggaaatgcctttttcgttgactttatcaaagttagattaaatttcagtcttagagtattttttactttccaaaatattagtttacaatttctgtttacattttgtgacataaaaaagtcaatatatagttaaacctttatgggatgttatttctgcataatcaaaggtgaaacaatgtctctatatacattaaaaatatttctcataggatccacaaaatactaatcatatttgttgcctaagggatggagaacttgtctgttttgtgcaggggtataaacggaatcatagtttaccacatagctcagctgtgaactgttattcataacaattaaattgtactgggagatgggaggtagtaagaaaagatggtggttggggccaagggatgaacagggagctgacttgtcacaatgtcaatagataatgcctgcatctgaaataaaagccatataagcatgtaatttatagaaatagatgtaaataccaaaagaatgaacttatagttgaatcatggttgcctctggaaagaggaaaatagagaaaaagcaaggcactcaggagaattatgtgattatgtacatatataacatggataaaaagaaaaaagaactaatgatataaatttaaaaaattaagaaactacgtatgtaacactattcaggaaaatctcccaagtgaaacttttacgtgattcattttgtattatgtaacaggctttggtaacattatgaatgcttgtaatacaaaagtaaataatgaaataaaataagcaatggtatagtcaaaactgggaagtgaggaggaaggaaaaaagaagaaaaaacgacaacacagcaagaccccatcttaaaaaaaaactaaccagcactttgggaggccgaggcgggtggatcacgaggtcaggagatcgagaccatcctggctaaaacggtgaaaccccgtctccactaaaaatacaaaaaaattagcctggcgtcgtggtgggagcccgtagtcccagctactcgggaggctgagacaggagaatggtgtgaacccgggaggcggagcttgcagtgagcggagatcccgccactgcactccagcctgggcgacaaagcgagactccgtctcaaaaaaaaaaaaaaaaaaaaaacaagaaactaaaatatattatatgtctgctcttttccacattgtacctagacaattctcaaatttgatagatcaaaagagacgtttaagcatatgtatacattttaacattgtcaatattttatttctttaaattttctgaacatgttttaaagaccccttggtatttaactgtatagatatgccaccacttatttaacaaacattctgagactatacgacgtgtagtggtattgccttttcaatataatatattttaggcttttttagtttgtttttcttttttttttttcttttaaggtggagtcttgctatgttgttcaagctggtctgcaactcctggctccagcaatcatcctatctcagcctcccaagtagctgagattaggggaacatgccaccacgcctggcttaataatattttttaaagttatattgttaactactatgattgagaacagtagttaatatgaaaagctccaatcacattaggaaatttagtatggaattatatcactgactgtaaaacataacaacatattaatcattaagaagagactgattcattagtcaataaaaggaggttattgacctactatgaaaaaaaattatatatgtacttaaatcacatgacattttcagttcactgatcaaactggacatatttcaagctacatgtaattaagagtgcccagtaataaaaggactaaaggaacttacctaaatagaaatggactcttctacatacggtagctgtaaaactgaggtatgttaagtaaggatgaatgtatgttatattttgtgatctttcatattgaacatacatcataataaatatatcaatttatctgcattgtcttctctttctcaagtatatgccccaacttgcaaacaagattgcaaattctttaaataccatgctaaagaccttgcctccaaacttgtcctctccaaatgtccacacacaaattcttcgcacagagctcaacctgatcagttgagacataatcattaagtaccaataaaaacttgctgggtcaaactgcatactggatccgtgcatttcccagcaactccaaatctgtgcagtgtctttaaaaattaaacctatcaaaaatgtatctcttggtcaggcgcagtgcctcatgcatgtaattctacaactttgggaggctgaggtgggtggatcacctgaggtcaggagttcgagactagcctggccaacatggcgaaacccggtctctactaaaaatacaaaaattagctgggtgtgatggtgcacacctgtaatcccagctactcaggaggctgaggaaggagaatcccttgaacatgggaggtggaggttgcagtgagccgagatggcaccactgcactccagcctgcctgacaggagtgaaactccatctggaaaaaaaaaaaaaagaaaaaaagaatctcttttataaagtatctctttttatgcttggaggtttacaagtatatcatatttgatattggtgtgtagtactaaaaactaaaaaatagcagctgttatcaagcattaatttctcagaatctttctaaaacacagtaaactcaaacatcataggaaagtagttgacaggaataatgagatattaaaggtattcacaagatccaataatactgatttctattaatatttagagatgggatagaacattatttcatagaaggtatttgaaaaagaataaatggggggaatgtttcttttatttatttatttattttttacctcatttccatcttcattaattattgagatgtagttgggatgtgtcttatttgggtaggacaacaggacatcataatgagctagctcagcagaatccaggccaaattctttccactgggattgaatttgctttgcaagctgaaagttttgttctgttcctgctaaatgtggtatctgtgtaaaattactggtgagcaaaaattgaaagtggttagatatgaatgtttaatcaacttttattccaaatcaacaaagaaaagcagagttacacaaaagtactttgaagtgtgatacgttaaaaaattaaagtggtactattattgcatgaaatagattttcaaagtctgctttgaaatttttatgctctaatttgtactaaatcaagagaaaaattggagaaactgatttttgtaccattatgtgtaatcctattactataacctcgtatggtagattatcatattctttcttaagacctgtacttcttgcaacttacatggaattatctgtttatatcactgtgtaaaatattgaaacagacgaaaatgttttatccaaaagaccaaggtgtgacatggcaagaattactaataattacatttatttaaatactgagagttatagacaagtgataagctttttgattagcaaccatttataaagtatcttcatcaaagaataatctgaacataccgatacaagttcagaatgaatctcttgcactccatctatcatacagagtaacacccttaaaatcaatgacaataattagtctgaagaggaatatctttaacaaagaaattatgtggccaaaatttggctaccagaaatattttcaggagaagactaatttctcatttaatttatttagattctggggcttttgattgttttaaatttctcccttctgggaaatttcttgtttccctgaagagctcattggtaagtatttttaacttaagcccttaaatatatgacaagatattatgtagcatgaaaagataaatatatatatatatttcataaacttttggaacttcatactttcctagttttaaatatgtagttttataaaatcaacataattccatccttatggtgatttaaaaaaaactaataaccaacgtgactatgataattacagtttcaggcttcattctaccatgtattttaattttttttcatttggtgaatcaataatgaattaaagtaactcgattttttaaaattggaatttcctgtaacttgtttactttaataattatattaaagttatttaaattgtatttataaaaatagtattaaaatcctcatttggtaaatgtttaggggcaaaatatcttacacagaatttctaatatggaaaatattgtaacaaaaagggcacaaacataagaggcagctaaggagtctctatcctttatcagtgagcacctgcagggaaaacagaaaaacagccaacatatcgctattttcttgaatattacgaagatcacaaactgctatgtaactaatgtaggatgcagatatcctgaagtgccagctatgcctctgtccctataagcaaaaggaattactatggggaatcttgaacctactcacaaaaaagcgggagaaaatcattataaggctttgctactattaagtgaattttcttgtaacagtcttgtcactaccaactaggaaacaacattttgctattatcagggttgggactcactcatttgaacaaaacacatcctggaaaagattagtaggagaaaaaaagatccattgcaaatactaaataaattaattagcataaatcatgtatgtggtataatacaggtgttgtcattaactcagtatgtaaccctagctgtgtcttgagtttctcatctgtatatggggagaacatcactgtctcactacttcacaaagacttgaggctcagttagattgcgtattaaatagcacttctcaatgattttaatcatttgagatgtgtgttacaagttgttgaacctaccagaatatcaaattttgtaaaaaataaataagaataaaaatatgaatttacaaattttcccaaatagccaaattctgtttatatatcactgtagggctgctttaaatgtgtttctagtattgtcacattatttcttttttttttttttttataagagacagagtctcattgtgttgccaggctggaatacagtggtgcaatcatagctcactaaaacctggaactccagcctcctgagtagataggactacaggcacatgccaccatgcccagataatttaaaaaaatattttgtagagacagagtctcactcaaggcatctgcctgccttgtcctcccaaagggctgggattacatgggtgagccactatgcccgaatacattatctcagtcctttaagagagctactgttatttctgttttagtacatttcatcttgtttgcaaataatttggcagtgtttccaagacttcaagatgacgaaggtattcagtaaaaggtggaattagttgggcacggtggcatgtgcctgtagtactacctactggagaggctggagctccaagctgcagtgagctatgattgtgccactgcactccagcctggcagcagagtgaaaccctgtctaaaaataataataataataataataataataataataataataataataataattattgagataaagtgacaagacaatacttggaatatatttaaaccagtctgacagagatctatgaatggatttttgctattctggaaagtgtgtcaattcttattcttacctttttttttaataaaatttgatatactagtatcaacaaattacttgtgacacacatctcaagtgattaatagattaagaagtgtagtttaatatgtgatttcattgggcctatatattcaaatacagacctatgtattcaaatacagaccagtaaaattctgagaccaaaagtctaaaacaccttttaaaacgatcttatccggcaaaacaatgtggaaaaggaagaatccctctagagagatgcaaaatggtaaacagatctgtgaattcaactgggtgttttcaaagaagagaaaacacagacaaccctgtaccccaaggcagagtgaaaaaaagctgctcctaattaatcttcccattcactactgaggcagacatttcagaggcagtgggggcttttaaaagcagaactaaagattttaaagggggaccagatggaaggtcagaggttttaatagtccctgacccatgggtatatttcaattgaaagctctctgatggacaaatggcaaattgaaaatctggagagtttaggaggcttctggagattctgtggtccttggaggagtgagagggaattctttcaatttctttcttttgtgtgtttatgctgaatatccccctgagttctggttagaggagcttggttagggacatggagaataaacaagaagctgactgcttaatcttgctgagggtccaaaaagagaaataaagaaaggcatttatttttcttctttgttggtcaatctatgtcacaagttaatgttacaggtagttagacaggagcaaggcaggagggggctctcccgccaccctctagaatgtcaggtgatggttcggttcagcaatgatcgcattgcctctctaaaaataatttagcagtgccagggagaggccagctcttgatggtccacacctgttaacaccaaaatgttaactgaatgcagactccagggagaagcaacttcctgggcctgtgtgttagagacaaaaatggtatagtataatcttccaggtacactccaccagaaaaaggaagagagactcagatgggcctgtgtatacttccctaaacacattgcgggtgctcatttccgaagggtcaggagggctgggcagcccaccctaagagaagaatcatgggaaagaggcaagcctaaaaaagtcctacgatcacagttaagtggggcacttggccttctctcaccttcatgtgcctgcttggctctcttccaagcacaccttcctttctttccttttgaaataaacttccattcctgctctggaacttgccttggtctctttttctgcttttgcccccaattgaattctttcttctgaagaggcaaggactgaagttgctgctgaccttatggataggctgctgataacctggagtaacttggatctcttccaccactaatattgggaaaggaagaaagctggaacagcagctctgtccaggagtaaagaccataccttgccagacctccacttctattatacctactatacattattatagtggaataagcacaaccggcagaggaggggtttccacaaagataaagaagttcgagcttcagagtctcacatttaaaacggcccttccaaagacctgagaggtatcctatcaatttttacttatacttttaattccgttgtaattaatacaaacatatatgtgtttgtatgattatatgtgtacacatctatgcatacctatgtgtgtgtgtgtgtgtgtaatggtcttttaatttagaattacaacctttattcaccagggaatcctgcaatcattagagggacttcaagtatttttggacacatgagctaactcaatttgtaaaaattcacaaaaggatctcacgcttaaaaaaaaaaagcaagtattctgggctgggtgtgggggcttacaccggtaatcccagtactttgggaagccgaggcggccagatcacctgaggtcaggaatttgagaccagcttgaccaacatggagaaaccctgtctctattaaaaatacaaaattagctgggtgtggtggtgcacgcctgtaatcccagctactcaggaggctgaggcatgagaatcgcttgtacccgggaggcagaggttacagtgagctgagatcacgccattgcactccaacctgggcaacaagaatgaaactccatctcaaaaaaaaaaaagaaagaaaagaaaagaaaaaaaaaacaagtattctaatcaattatatatagtaattctatataagtattttctttttggttgctttttaaatttacttatttatctcttttgtcctacactggaaatagctatttcaggaagtagagagctagtttttaaaatatgccaagtatatgctaaatatacgctcttggacttcatccatatcataataagatcattattcccattttacagatgtggaaaagagagctcagaaagattaagtattcatccaaagtattaataggcaaagatggaattcaaactcaattctaactcaaagtccatttttgtttaactaaaatgcaatatctttctctaaagcattaatcagcaaactaggttccactggccaaatctggaccactaactgtttctgtacagtccacaagctaagaatggtttttatattttaaattggttttaaaaataatatttttgaacatcgattatatgaaatccaaatttcagtgcccataaggaaagttttatcagaactgactgtttatgtattttctatgacttcttttgtgctgcaatagcagagctgactagatgtgacacagatcagctggcctaaaaaggctggtccttttacagaaaaagtttgctgactcctgctctaaacctctgtaatgacaaaatttagctgaaagtatagtcctcctcagatgaaatgtgatccaagatcttcaataaataaaattttaagaaaaaaggccagttcctatatataaaatattggaccaaaacagaatgataaatttttctaacaacttgtccatataaactttcaagaatgtgcttactataagaacttcttgatgttctcagctttcaattcatccaaaaatgctttcatattatgctttggagtaatgttagtagcttcattggaggattttataaaccaccctgaaaaatacatccaaaaataggcatgagatatgagcctatagataggacttatttttcattattgttgtatgtatcatttgtaaaacacaaattatcaatattacctctgacattaggtgagatatttctgaattttaatttctcttgcctactttcactgaaaaagagtcatgcaaacagatttttaagttgcaaaccaattgcaaaatattttttatccaacttcaatgataggtattgctgttactctaagaaatgttttatgagataatcaggacgaaaataaaatgacattgatgtttcaactaatgggtatacatgagatgttctgaaaatgaaggcaaaaaggagatccaccttctactttcataaagtttctatcttcctctgctgactcagaataagcatttaatacatttttataatgaattaattatgaatatatttcaaatacataaattatttccaagtgttgaaggaaattcagacttctaatttgctctgattctgaaactaaaacaaaatgctgtgagagtttgtgtttccagtgaagtaggcttgagaaatccaagttcagacagctacaatgaaactacaatttacccagcctctctgccagacacccagtgcacgcataggcggccagaaacaatggatagctagatcctgcagtcactagaccttgcagttggcttttaacctgaaggagataaggcaagattccagggtttatttagagaaattacaggatctgggaataaaatagttacaaaattagtgcccaaccagctttcatggagctttccaattattaattattctagttcttaatcgcatgcatacaaatgcatatacatatatccatgcatattaaaatacatgattggacgcaaatggaaataagattccacctgtgcgtaaaacagaaagacttggattagagtgagggatcaggaaacaccacactgaggatgagatgctttaactgagatctgaaaaatgaacaggatgaagaggatggaggcctgtagggggaggggagagcagagaatcctaaggggtagggggcggacatcaagaaagaactcttctgtgtcagccactgagcacggaatacagggatgagagtgagggcaatacgaggaagaataaaatccttttaagagatgaagattgttatgagcacagtgtgtggttcaaaaatcttttaacaaccccaaggtgaagctagttgaagatactgaatttgtttaaacccatctggtccatgccctgttcttctaaatcccgaaagagggtcaagaattccaagcaggagtggactacctggtgataccttagactagtcctgtgtattaaagtccaatgaggagcatcttggtaaaagaagaaatgaagtggcgaaaatcccagtactgtgctagatttacatgatatattatttactattaccaataatttgcagataatattatcctcatcataaaatagggtaactaacgctgagagggactcggtaacttgttcaaggccactaagaagtggcaaagtcaaaactggaatttaataaaagagtctgagcttgcctgtgtggttctgcttttcttagaaagttggatcaagtctgcaaatcagtacccaggaaaaacagcaaaagacctgctggtaaagacctgtccagattgctgacctggttcacacagttcccaagcttgcctctgttacttccaaggaagaaagaatgcacagagaggaaaaaaacaaacaaacaaacgaaaaaagaaaacaacactggagcctggtaacagagtgagactctgtcaagaaaggaagggaaaggaagggaaggcgagggaaggggaggggaaaggaggggaaggaaggggaggggaggggaggaaagaaaagaatactggaacttgttgaaggcagagactttattttcatatcccggctatgtctggctactgtcttacctaatagatataaaatcagtcttggttggattaaccagaagaatcatcatacaaaattatatccctgctataaattcttaataataatagtgatatttcgagggagagaatagctacatgctttataaaataaactgtgttcttataatccatgagagaggccgtgcatttactaggagtactttatggaagcactgcttttaacagaaccataaggtacaggtaggatttgacccagtggagatgagaagaaacattaggggccatgggccagctgagtaggcaaaggcagaaaactcagagtgtattcaaggaatagcaaacagtttgctttgagaaaaggagagcacagtatgagttaagtggagaaagatgggctagattgtacagtcttgggtgcttcgatgaagactttctgcgcaaagtgaaaaatttgggaaaattaatttgtcagcaatgaaccatgacaactcctagatgacctagggcaggaaggaagggaatttcttcatctctttctaacaaaatcctgaatgtactatatctttcctaatgttcctgttgtcaaatctaatcagagatggctaataatagtgactaatatttaaagagcacttattatgagtgatgcattttatgtacgtcacctcatttaatcaccattgggacccttcaaggtttgttcttattactcttcccgatttacacatggtaaaactgaaatttagctagattgggtaagtcattcaaagtcacaaagctaagacttaatataatgtctgtctgtctttgtaccactctacagtctctattcagcacaggatacctttatggagtttgcttgtggcactggagggagcactgagtttggagtcagaagactcttaataatctttggacctggtcctgtccaagctgtgtacccttgggtgctaagtattcagcttaccagaatatatcttctcatttgtaaaacgtgggatcacccagtaacattacgcagtacagttggttaatgtgttttctttgaaggttagatgtgattataagtgagcaaatttcagttaaatataaaagtgatttttgaacaatagaatttattcaattaataattgaattaataagtcgctatggtgaagaggatgtatttgaagaattcagacaacgaatgaacatctgtcacatattgtaagccttgtggaacttacagtttagtggagaagataaacgttcaacaagtagttaataaccaatatactgagcattttctatatggaggacactacactatgtgctttatatgcattatttcatttaattctcgtgacttatcctgaaataatttaaaatctctaagaggtgatgatgtaaaccacactagatttttctgttgcaccctgtattattatttaccttttacagataagaaaactgaggtttagagaaattgattaagttttgcggagcgctaaggagttaaaagaaaaatgaaaaatgggcttagctggcaggaacagaaacaggggcagaggggaatgaatgttccaagaatagggtcaactgcaaatggctcacttaacacccaagcatcctcttacaagcacccagctcatagcccatctgtaaccaagcatcctgtctgcaagcattcagcctaaggagcacccttataaaactccactcgagtccctgcctctttgcagacagccttccctctgctgtctggccagttgctccctttcaatgtgtctccccttttctctaaataaatacgcctttctaaactcattactgtcttggtattaaggtaaattcttttactacctgcacgccagcctcacacagttgttgaccatgacaactttctcaagaaaacaattggcagatgtttgttttctgaatcccaccaataagcattaggccatactatacttccttctttaactattggaaaaagattgaagatgactcttcatgtcagaatttatagaaacaaacatgaactaaatcagagtattatactcatctatgaggtgtgttctagaaaaaaattaaaatatttttaattcctcttatttccagacttttacccatatttgcctttgaaaaatacttagtcaagaaaaatcaccggttgctttatttatttatttatttattgtcaaagtctggctttgtcacctcaaactgctgggctcaagccatcctcccacctcagcctgccaagtagcagaagctacaaacaccagccaccatgccttactcattttaaaaaaatttttggagagacagggtcttgccatgttgcccaggctgatcgtgaactggccacaagcaatcctcttgtctcagcctcccaaagccctgggaataaatacatgagccactatgcccagcctccttggctacttcttaatctgtaaacatagcattcttggactctaaactgcatgctaaataacatagctctagaagataaaaattctaacttatttctccaagtaatttgatttttttaaatttcagtgtttttaaattgggggtggttacataggcatttatatttgttgaattccttttgtcatatgttaaaaatatgtgcactttattgtatttaaagtataaagtttaaaactgatataaacaaaaagatatggccatagataaataagaattttccctaatggttcatctgaattccattgtttcaaagtaattaattctcattctccttatgctaactttacctaaagtaggggaacatttgcagagggaactttgtagacagatttctttgcttcggaattttgaaaaatagaaaatgtggtaatactgtttccaatgtaatgatgaaatggagtagtaaatgaacatattttaggaaaaaaatgcttgtaatatttaaataaaatatatattttttcctctgttaatttttattactaaaataaaatgcttttttttttttttgagatggagtcttgctctgttgcccaggctggagtgcagtggcacgatctcggctcactgcaacctccacctccccggttcaagatattgtgctgcctagcctcctgagtagcagggactacaggtgtgtgccaccatgcccagctaatttttgtatttttagtagaggcagggtttcacgttacccaggatggtctcgatctcttgacctccttatctgcctgtcttggcctcccaaagtgctggaataacaggcgtgagccaccgcgcctggccaaaatgcttattttttgatgtatacagaagtataaaaagtaagaagcttaagtaccattttataaccctctgtcctttcccttaacatatcaccatccagagatgaataccatcaacattttggtagtaattatttgagacatttttcttcaaatacacacaatagttcaaatgaaaaatgaaatcatgctatgcctttacttttaagaaaacttttaattaacatatacatacataaaatgtacaagtcttaagtgtacagcttgatgagtttttacaaaatgaacacactggtcattcagcatcaagatcaagagacagggtatcaacacaactccacaagccctcatcacatcccctttacatcagtatctttcatgctgacagatatccactattctcctattctaaattctaaatactgtttagttttgctcttttgaaatttctgtaattggaaccatgtagtacttgtatgtttgtgtttggcttgtttccctaggaactatgcttgtgaaatacattagtagtgtgctagtaaatcagctctaaagaagggaaaaagccttggtttgcagcatttactgatttctgtgatgcaaatattcccaccatggcagatttcaaggaaacagcaagaagttactgaatgtgcagtctcaaagggaaggccacaattgccttttgtaagctggcagaagcaggctgcagcacaccactggacactcgctgtctttccatgtagcaatagttcattcattttcagtgttgtggatttatcaattgtataaatgttttgcaatttatttatctattctctccttgatagatttttagattttctccagttcttggctattagaaattgtacttcagtgaactttcttgtgcatatcttttggaggtcttatgtatttatttttgtgggtatttatctagaagtcatagctatgtatatgttcagctttcgtagaaaattttagggttttctaaggcttttatgtactactcataccagaagaatatgtggaattccagtttctctctgttcttgccaaccaactggtattttactgatgacaactaaaatggagcagcttttcatgtggttgtttctaatttgtactcttctttttttgcactgaccaagtgttttgtcccattttctcttgggtattctgcctttttcttttttatttgtaggagtttttgtatatattatgactacaattttataatttattttattcaataatgcagagttttacatgagcatataaaagatctatcttatcattttgtcactttatagtatttataaaatattatatttataatattttaaagaatagacataaaatggggtatttcatttttattcatatcaaaattcttatcaaataagtgatttgcaaacatttcatttgacattctagttgtcttttcactttcttggtaatatcacatgagtacttaaaacaaatttttttacgtgtacctgattcacatgagaatttaatagatgctccctgacttacaatgatttggcttaggatttttcaactttatgatgctgcataagtgatatacattcagcaaaaaccatacttcaagtactcatacaatcattttgcttttcactttttgaacagtattcaatatattacatgagatactcaacactttataacaaaataggctttgtattagatgatttttttcagctgttggctaatgtaagtgttctgggatgtttaacttaggcgaggctaagttataatgttcaataggttagtatatgaatcatacatacctgattttaaatttatctcagtcagtaactcacatatgcaaatatgggcaaattgttcaattttgcctcattcgtaatgtttaccattcccagaaaaggttcttctcaaagttaccaatggtctacgtcttttcaaaggcagtgatcagttctttgattctggtgtgtgtgtgtgtgtgtgtgtgtgtgtgtgtgtcagtggaataactgaaccatgtgacgtggtatagccataagaattctttagacccataagaacatctgttcttaccaaacaggaaaaacatgacaaaggtgtaggtttccatcaagatcagaagtattttgacctatgtaagaagatattttaaataatataaaagccaaagaaaattaaatccagtgatatgaccctgggtgggtttgcagagttctgtgggaaaaaaatattacaggtgaaatccaaactgaagcatgtaatgtacctgagctataagatctgcaagaccatttagtgagttgatattgtgactacagataagaatgagtatgttctatcacagtaacagatatcagagtccctggtcaatatcttaggcgaatatgcatattccaaccatctaggggagtatcctcaaagactctgtgataacactgttgtttcctttgtgggaaagcctacttttacccttaaaatatttaaagtaaacatagaaatatttaggtaattaaacccattagttacaataagtttaagcatatttagtatttcaaaaatgtgatgtgtactgtacagaagaatattgactattcaatgaaacttgtttccaatgtaagctgtataaattgagtagttgagctcaccttttgacttttaaattcaaagtacttactgtatttatatgcactgtgactggaatatggaaaagaagttaaaatcgggccaggcacaatggctcactcctacaatcctagcactttgggaggctgaggtgggcagattgcttgagctcaggagttccagaccagcctgggcagcatggtgaaaccctatctctacaaaaaaatggaaacattatctgggtgtggtggcttgcacctatagtcccagctactggggaggctgaggtgagaggatagctcacacctgggaggttggagctgcagtaagcctgagtgcaagccaccgcactccagcctgggtgacagagtgagaccctgtctcaaaaaaaaaaaaagaaaagaaaaaagaagttaagattactcataattgtgaattaaatatattagacttacaagaattaattttaagtacttagaaatgtttgttggacagaccattgaagtacctaaaatattaatagaatacatttataaacgttatttaaaatgcttaacagtatttaattaactatgtaaaataagatgaagactatgagatatcctgtaagttactgttaaagtttattagatttctaaatagagtaagatatgccgagaccagctcggtctgggagaccctaacccagcggcactagaggaattaaagatacacacacagaaacatagaggtgtgaagtgggaaatcaggggtctcacagccttcagagctcaaagccctgaacagagatttacccacgtatctattaacagcaagccagtcattagcattgtttctatatatattcaattaactaaaagtatcccttacgggaaatgaagggatgggccaaattaaaggaataggttgggctagttaactgcagcaggagcatattcttaaggcacagattgctcatgctgttgtttgtggcttaagaatgactttaagtggttttccaccctgggcaggccaggtgctccttgccatcattcctgtaaacctacaaccttccagcttgggagttagggccattatgaatatgttacagtgctgcagagattttgtttatggccagttttggggccagtttatggccagattttgggggacctgctcccaacaaagatatatatatatatatatatatatatatatatatatatatatatatatatatatatataatatcaagaagctaaagaacagggttttttttttttttaaatgtagcttcaatcagttaaatattgattataaaaattaaagtaaaactatgaagagttttctgtatataaacctgtcctcaaggatataaaaaaacagtcagtgcagacactcagagagtttaacaaagttaattgctaattccttcattaacactttccttctagactgtatgacaccatcgtcctctgaaactgactggcgtcccttctcagtttcctttgccagccctgcctttttttaccagacctttaaatgctggagtgttccagggctctccctttggccctgctcttttcattctatagtgtctcttgaggtgatttcaaactccaagtaccatctatatctggccacaactggctagaggttcaccaaacacatttccctattgttctgggaatacagctaggccacatgtctcagtctcccttaaaggtaggggtgtcctcattattgtgtgagagctaataacatctgagaggaagtgatgtatgccccttccaagcttatcccctctccaaaaacctcctatacaattttcccctctctttatttaccctaatggtttctgaaacacacagaggctctagcagaggattcagaggccctggagaatgatacagccacagacagaaagagcctagattaccgaaccattgctaggagcaatcaataatacccaaataaactttatagcaataaaagaataaattatttttttaactgaatggattgatttggtacagaagctggtgcactaaacacttctgatcttgattgagatcagcattttttttcgtatttgttgtccacttagacttctcccttgagattcagcattaaatatgtaattacttaattgaggtctccaactggaagtctattagctcaaacttcacatagtgaaagataagttgctctacaacccactgcccaacaaatttactttgtgcctccccaataccaacccaacctattgccagacttccctccctgtcgtacctgaataaatgatgacaccactcttcacagcagttgaggctaaaatccggtcactcttgtctattttactcataaccagcaactacctctacttagtcctaaaagggaaaaaaagtcatcttttccttgtaaacctttgcctttactctatttttctctgcaaaacaaagtttaaactttttatcaagatgtacaaatctttgcaaaatctcatacaaatctagtcttgtgaggaacttctaccttgaaaacctcatgcccctggtcacagtgaaatagatgaagagtagatatatgactcagctttggagaatatttttgctaaggtgttgaattcaagtttaaagtgactggaagcattacatgagtggctagctagcttctacctcacatatgaattgaataacgaagaaagcaggattaactagaaagcagaataaagcaagtgcccagagaggagcagaaacaatattagaaatggagcactccttcaatttataatctccaagatcttgattcctgcatttcctgagacccattgtcatttttagatttggcttctgtgagacattcttgtgtctttataataagcccctaccaccattactccctctcttttttgcttaagctaactggaattggtttattttatctaccgtatagaatcctgaataattaagctttccagcctcatctctaattcactagtactccccgcttccctcctgccatcacatatgaaaactggatacattgaacttcaaatggtttctagaatattgttggctattttgtgatattaggatttttaaaaaatctgtctcatttgcctgtgatattcactgccacttagctttctggaaatgttttagtcatgcattagggctcgtctcaaatatcacccttgcattggacttatttggaccttctgcaggaagatattttttttctatcttttgtgccgtcatagtactctatctacccatctgtaatgacatgaaggacatgaaatcattattgaaagattttcttcctcattagactgacgcaaaggcaggaatgatgcccaattaattctgaatgcctcaagtataccacacgatttgacacacagttgtatgtctatttgtcaaatgaaggaagaaatacatgaaagaagaaactgtgctagccctgccaattattattttagcagatgatatcttattttaattgtttaagtttcaaatgatctttgtggtatactggcttatttgtttaggttatttctcagcacattctttgcatattttattacccatcagcaataaaagtcaagaagggaaagaaggaattgtaataatcagctcttcacacccttatttctcttccctagtatttccccaagtttttattttgttctcacaattaagtctatactacttagaaaataagatcaaatcttctatgctcctttggttagaaatttttctgggatggatttaaagttgaacatctattgcaacttaaaatttttgttaaagttgctctttctaatggcaattattttgggctagaggataaatagttggagataatggaattttctcttagtgttattgctgcctcccttcttctatatcttttaatggactctttggaaattataataataatgaatactaacttaatatttatcaaccacagagccaggggctgagccaagtgtttttatatacattgtcttatttactccttttctcagcactgtgactgtagtactttcataatatgtataactttagaggtattttgagttactaagaaataacatgaaaacaagctttttgcacctgtaagattactagctaggacggctttgtaagagaaagacctctttacccttcaggagtagcaggaaaagtatgctattcaacaggattggcttatccacctgactctgacataatcatatatgaaatgatactgacatcagctttctttctccaattgttgataatttggttccttatttcttgtccttcctcttgagtaatttgatctgtcctcttcctgttcttcccttccagagcaggaaagtcaaaggaaaggaggaagttgtgtagaagaaaacagtttcaaggggcattctccagaaagactgaaacattatgctagccggtcaaaacatagtttgagaagttaaatttggattagaagtctctttctataaatgtttttttttcaatttttaaaaattttcatctttaaaaaatgtgtttgccaaattttatcaaaaagctccatctttgtcctagctgaactcacaggaaaaggaatgttttcagatctcagatctgaataagtaggggaacagcttatctctgagggggcaagctggtaaagagggctccatttgaaaaacttggaaacaagaaaggattttaagtgggaaccaggagtttctcttcaaaataatcctttactctctgttcattaaaaatatattttaattattatatatttaaatataaatttatttatttaaatatatattaatttaaatattatatatttaaatatatattaatttaaatattatatatttaaatatatattatatataaagatatgtattttaaatattatatatataaatttaaaaagtagtcctttcagaaggtctaaggatttctcaactgctgataatcacaagggaacaaactgagtctctagatagggagaaagtgagagttgcaacatagttccagactccagaagaaaagggttcacgtgccacagattgccaagatatcctgtgataacttagcttctgcttagagtgcttaggcctagatcgcctatctactattttctctatttcttgggaaagctgtctgattccatctgtgtttctatctggatatttagcacttatcgccattttattatattatcatatattattcaactggattatgtggtttaatagaatgttgggctaggtatcagaccagtggtttaatgcactgaaaacacataataatgttataataactaacagttattgctcatttgctctgtgttggaactgtgcttaatgctttacatggtatgttgagaattactgaagagttcagtgagcaacagactatatgataaaaatttagtttggtaacagaataaaacatgtaaaatgaagttatctgtggtgtatgtgggatttgtccttagacataagtgtaggagggggcatttcagatgaatgttgctatttctacaagtcaagccaagtaacttaatagaataaaaatttgccattattaattattattactattaatttagtcaggcctgggcagctatatgtcataccttcagtaaaaaggaatacccatagcctagacattgaaactagtatatttattgttccagatacttaacacagctgagtgatgtccttcattcaggagctcctggggaacacggtgctatgtaatagagtgaaatgggaatcagtgagaggaggaaaaataacttcatcaggaatgtgaatgcaagattcttaaaagggcagagtacttttctcattcgttgtttcccttttacctccattcaattaaagagacttggggtcatcgatgtttcttttctcttccatttcatttttgacttaatacacaaatggagtacgttattgacagaggggcccccttgtggtccagcgtaaactccctcattcagtcaaaactgcacaccgaaaacctatatgatttcataagcaagtggcataggtgtttgcgctaggtcatatttcaacaggtagcatacctccaacttatttgtttatttttcagttgcttactttgtatttgcattttctgggcactagattcttggcaagaatcaggtaaggctatcatagcccaatatatggagctctgtaactgagcactttaaagaaaatagtcctcaggactttaaaaaagtttttaaaaacgtttttaaaaagcttttaaaaggcgaattaaataattatttgttttttaaaaaatatttgtacctttaaaatgctattaatttaaacatgattatggacaatagattgctagtgataaatgatggggttctggacgagccagacattgtacagcttcccttggggcaagcatggtgatcaatgtgggtttcgcaagctggagtcattcaacttggtgttctagtcttgtatatatatttaatttcatatttaaattgtacaattatgttattttgactatagtcaacctgttgtgctattaaatactagatattatttattctttctaactattttttgtacccaataaccatccccacctcaccctcaaagcctacactaccctttgcagcctttggtaactatccttctgctgtctacctccatacgttctattgttttgatttttacatcccacaaataaatgagaacatgcaatgtttgtctttctgtgcctggattatttcacctaaaataaaatgtttgtctttcacctaaaataataaaatgcttgtttttctgtgcctggattatttctcctcaaataatgatctccagttccattcatgttgttgcaaatttttttcatgtgtctttaccttctgttctggtaccatacccatctgtgttcaattttttttgtactgaaaagaatatatatatctccaattccctgtgataccgaggaaagacagcatacacacacacacacacacacacacacatacacatacacacatatatgtatatgtatatatatacatatgcatatacagctactgagtgacaagtggtatggtataatatcacctgtcactcagtagctatcatatatatatatatatgtgtgtatatatatatatatatatacacacacatatatatatataaaacaaggaattgtttccaggaactccaaagatactgaaatctgaggatgctcagctcaagtcccttatgtaaaatggcatagttatattgtttctctgacttttggctaagatgaagtttagtatctgttcttatcagtttaaagtggcatagtatttgcatatagcctatgcatcctctggtatacattaagtaatctctagatttatactacttaatacaacatacatgctatgtaaacagttgttacactatattttttatttgtattatttttattgttgtattgttatattttaatgtttgttatttccaaatgtttttaattcatggttggttgaatctgtgaatgcaaaatccatggatatggagggctgaatgtacacacacacacacacacacattcataattttcaaagtccacagtaagtatcaagcagtgtgtgtttacctgcatgtgtatgtgaattaactctgttcctgaggcagttttatttccctccaatggattctactttatttcttaatgtcaagaaatggcttatctctatctgagtacctgtacttcctttctctgtctctctctgctgtctctgtctctgtctctgtctctctctatcttagtgtttgtgtgggtgagagatcgccattctgcctgcaccactcaaaatgcagctctcctaactaaaagactgtattattcacggaggtctcaaacgaaaatgtttctcccattggacagaaatgagaatgccctggcacttctcatataacaccacttaatatattctttcaattgcaacagtttagaattattattgataaataattctaataccatttagtgtccaataacatattagggaaacatgataatttaccacatcctctctgtattcttgttcatttatttttcattctgtcgtactctgtacctttttataggccacttcaatttgttttttactagagctggaaacatgttacttctcctatgaaccagccaagtttttatgtgcttattatggattcaacatacccctcttctcaattcacaacaaatggctcctctctatctgagatagagcaagttgaagtcctatccctccagtactgtactttacagtgtgaaggcttgggacagattctcttccacagcccccagaaggaaccaatcccactgacaccttaattttatacttctaacatctataactgtgagacaataaatttttgttgttttcagccactaagtttgaggtgatttgttctggcagtcctaggaaactaatacagtgcctctattaaaacaattcatcttgtttactccagttttgtttttttttggcatatctgtttcagactggactatgtacttatcaagagaaatgaccttatctgtcatatacttcactctgtggtatttatgtgagggacataaaatgtaagatatgatatgctatgtaagatatgatacctgccttaaaatccagtgtttattcatcaaatttttattgagtgcctgatgtaattatgtaacagccactcctcaggatactggtcatacaacggtgagcacagagatgatggtctcctctctcgtggagcaaacagtctggaaaattgtggggtgggggggacattaaaaacacaatcaaaaggaaaataattgcacaaaaataattgtcaagcaggagaaaaacatctgtatgtaaagaagaggaagcagcgatcgttcttggccatgggatgatctggaaaggcttctaaaaggggcagtagattttaataaacagcacacagagagagaatatttccttgtgaagaagagaatggggaaggacccctgggtcattagtagttcatttgcctggagcatagagaaatagagtaagtagagtaatcatggcaatagttttttgggtgtttttaaattgcttactaagtatcagccttacattatctcatttaccttcacatttttttgacgtaggctgttgtcatcccaatttacagataaggttgttgagttttccttaaccatagctttatacttattattatactatactacctgtcactcagatttattcctagggataactataatttgaaatgagatctctgactccacaggctctgttttttttttcattccacaacagagaattattccctaaaatgcagagtcagaaagataggttgcaggcagattttagaatacttctattacaaaggctataaaaatatactttacagtaaacaaaggggaaaatcaaatgtctgcaaagtagtaacatgatacatgctaaaacattgaaataggaaaaaatattgggggaagtaggattccttagcacttactaaaggaaagatccagataagaaatgtaaatgtaccaggcttggtgtctcacacctgtaatccctgcactttgggaggccgcagctggtagatcacttgaggccacgaatttgacaccagcagggccaacatggtgaaatcccatctgtattaaaaatataaaaattagccaggcctagttgcatgcacctgtaatcccagctactcaggaggctgaggcaggagaatcgtttgaacccgggaggtggaggttgcagtgagccgagattgtgccactgcacttcagcctagtcgacaaagtaagactctgtctcaaaaacacacacacaaaaaaaacaacaagttatgtaaatccatcgtcagaatgacttagtgtgaacaagaagcatctcagttgtctgctaaaaattccggcttcttcgcaatgagaatattgaaaaatctctcttcaaggtggtggataaattacctcaatttgatcattacacaatgcacccatttaaacacatatcgaaacatcagattgtaccctataagtatgcacaattattatgtgtcaattatatttttgtttaaattctacttccagtcaccaccccagaggactgctgacgtgaggaggttttagacaatattctgttctggcctagccaagggattagggaggcaatgtaagccaaacttcctttttcacagcaagctcttggactgcagggatcacatttcattcatctttttattcccttttcccctaagtcccagacccttgctcataataagcatgtggatgacttgaactgaattgtaagagtgaaagactcttgtgaaagaagaatcattaagactgtgtgaatttaaaaagagaacgaattcaagagaacatgctttgtaagtctgggaaagagaacgtgcagggtacaagggcggtaacatgtgaccaagaagagaagagtaaaatgaactcactagccaattacattccagtgatctgctacttagaatgcatgactgaactcctgggtggtcttatagccactgggtactttttttctgccagactttgaaagcactttgaagacagggtgtcatctaaaggttggtgatttgtattgagttcccccaccctagaactggcaggcaccattctctttgataaatatcataggaagaaatcagagaattgtattttccattgaaatagttggaagatatatagagaagcctaatgtggttttctgagttggaaatttgctaggacatagggatgtgaatgcccatcttctcaaaagacatcctgtagatgccaatagatctgagcagcaggatggaatgtatcaaaataaatggcaggattatccagtgctggagcccttatttaagaagcccatattaattgaactgaacatagttggcattccaacaaatatatgctgaaagaaaaatagcaaaaacaacttaggggatatgttctctcaagtggtttataatttgtttcctaaccttctgtcactgaacctggctggatatggaaaggtccattctactttcattctacttcagctactcagatcttagttgtaccctagaacttttcatgatggataattgtacccttctatacttttcatttaaaccatgtcactcaccaataatcacctacattttcagctaattgcctctagtgccttggctccaaacattctttgaccccactgtatttacacttttcctcattcctttatacccctaaaatttgcagtccccttcttacttagctaatattttacaatctctcccacaaacaccctcaaatagccttgcatctctcttcttcattgtgttacttttgtaaaatccaggccctatttaaatacaatgttccatgtattctgtgcctgaacctatgcagctgatgtagctgaagcaaagcaggggtattggctggcctcactttaaattcttcatccttaattggaaatgtatcttcatactccctggtaattctactttacatatttttacacctattacttttcctgaacttccaatactgcctcgctcctcttcattttggtttatgaacctggcttcctatttcactggggaaatagaagtaatcagtaataactcgcatgtcttttcaccaccacatcgaccagcccatcctatctgtacatgtttattgtctctttcttcctgttcttacttgagctgtacatgctcctatctgatcacacttatgcacagggtctcattcattctctttcacttcagcaattagactcttccttaaaaaataattttctgtctcaacttgattattcccacaatagtgcaaacatgttgtaataccttttttctttaaaataacccattttctttaaaataatttccaactatcaactgattcctctgtttctctctatataaaattccttaaaagagatttcttatgttgcttctctcccttttctctcttcccattctcatttgaatctacttcaaaaggtttaccatactaagaaaaaaagctcttctcaagattacctatggtttccatagtgctaaattcagtgataaatttagtctttgtcttaatcagcctctcagtatctttgattcagcgggtaattatctccttcttaaaatactttcttcacttgacttctgggagctactctcagttttcctattcactttagatgttcccctaagctctgtttactcatttatctcatccctccactggagttcactggagttcagtccttagatcctttctctatcagcattcactcacaaggtgatatcacatagcctttgaatagtatctgaatattgatgatggtcaaatgttatttcccctgaactcgagattctattcaactcctactagacatccttacctgcacaattaatagacacatcaaatttaatatatcctaagttggactcttgatgtcctgctcctccaaacctggtcctcttgcacattttctatctcattaaatgtctatttcttcccattgcctaagcaattcagagtcactctcgaagtgacttttctcatttccccatgcatatttgatccatcagttgtgttaattatgccttttaaatgtgtcaagaatctaattactcctcttccactgctaacttttgttgaaatgaccatcagctgtctcttggataaatacaatcctttacttttggtatttctgattcagcatttgcttccttattatccgttctgaacatagcatctgggtcagaggtcttgtcaccctctgtgtcccaaagtctacagtgattcccaccaccctccttatcaaggctaacaaggccctacatgatctggtccccacttcttttcagacctaatttcttctacttttttcaggcttcactcattagccacactgtcctccttggtgtgcttccactcttagcacattcccagcaaaggccttttgttctgattgtccctcttcttggagctctcttccttaaatatctgcaaaatatctgcttatcttcttccatcacatccttcaggcctttcctcaaatgccaatttctcaggaaggttttccctggcaaccgtatctaagattacgctttcctaccccagcactatctaaccccatccctgcacagttctcttcctatttacagccatctaacctactacatatgtgacatatctatgtattgactgttttcccctctagaatatatgtacaatgagggcatggattttgttcactgtttcatttccagcaccataaagagaacctgatatatagaagaccctatataagtaacaattgaatacttaaaggcaggcaactctggggtttcttccccagacctctgtaccagaaattgaaataggaaatagaagatattgaggatactaggtattctctacctgtgttattgaccagaaacagcaacatataatttttctttacagggactaagctaatcaataatgaagcaatgtcactgacaatcacactcatagaatgaattttaataaaaatatatttttattttggatgctttttgttgcatttgagagaatgaattgagaatttttgtttttttaagtcaggtggactcctaataacttttaaaggctaagttaaaaaggtctcattttctctaaggcatttatgacttaccagtcagtcagtcactctttcctcagcatattttatgtatatcttaactctagctcttatcacattatttcatagtttgctgtattgggttaattccacaactaggctttgtgtccccaggagctacaactgcttctgtcacatagtaggttctcataaatctttgttgaatagcttatgtagactcagatgccacaagattggcaataattcactgttattacaaaaagagaattaatataaaacatcaccttgtttgtagacatattaaagaagaagggaaccatgaaatacaatctttaggaattacaatgtgtcctctaagttttggatttaattgtcctacctaaatcttaacaaacaaaagcacattgatactttatttgtcttcttcttatgttttgtattaccctgacttagtcaccagatgtcactatgagactgttgtccaggtcactctttctttaaacaagaaggaaacaaagacctcacatgaggcatggagcaaaacctatgtccttgtggaaacaccttataaatgttaaggctagtagatttagggttttattttagagtggattttggcatggcttagtgtgtaagaaagagcactggactgggaatcgagaatcctggattttagccccagttctgtcattttagaataattgaccacctggtagatttctttacttttctggcctgtgaaagatatcctcatctgaaaataagggtggcaaaagaacctcaaaatcttcaagctctaacatccagtgattctattcccttcttttgctaatttcttggaaagtagccagaggtctttactaccagggatgatttggaaagtcagcataagtgagaataatgagtacctattgcatactctattttattctaaacacagtctctgctaggttttgacctaccatgaagtggggaaacctttatggtcactctcacttctacacagtctctgtatattggtggtacacattgtgtgaaataccttttccatctagagattgcttcatttttttattataaaaacattacacaaaatttgtttaaggtgtcatgtaaatatacttttagtgactgtcatttttgggtttcactctcagaggaaaatgaattatttatattaggtatttctgaatacctaatctgaatattcttgcttttttttaaaaccagttctctgcaatgttcacccatccacctacctaaaatatgcaccacttaatcttttattcatgctgctccacagcgtcctgtaatcataacccacttgtggtagactcagacactgttgttgtatgaatgcctcatttatctctttctgtgcatatttatgtttcagttagctattttcattgcatgtagttccttccatagtgtgggttctcgtattctcagccattttctttgtcattattttactcagagtcgaaccacagagtaaatatttttgagaacagtctgaattacatggagcctttaacacttacaggcactatcctaatacccaaattattatatagaacaagttgacacaggcttttatagaattatctaatcctgaaacatatcttgagtatttactaaatgctccacactgttgatgttctgggattgaaacagcagataacacagtatggcacagagagagcaggaacaagcatttacacagcaaagtggtgaccgttacagtggagttgtgtgcaacacactgtgagaggctagaggatggtatagacttacccttgagctgaccttcaaaaatagtcaggagggtttgcatgggaggttgggagtctattccaggcagaggggacagcagaggcaaagaaaaagaggtttgagactacatattagactggagaagtgcatatggtctgtacttactgcttagcaacagagtagaatgatttgctgggaggtgagactgaattaacattaatctattgatttctctttgaaatttacaaaattttctcctctccccttccttctttatgtattttggttctactggagtcagttcaggtgtttcttaggaaattgttctttatgatctctgtgagttgacattaaaatatacattatgtatgttctgtgacacattgttactcttacatgttagttgtttaacacctacatgggctcttgcctcagctaaacagtgagttctcaaagatcacattcatgattagcagccacactgaattattattacatggaagaatggaaggcaggaatgaagaaaggaatggtgggagggaggaaagaaggtaggaaggaaaaagaaagaaggggcggaataagcacttgtagtggaagatggaattaatgtttttcaagagtatcttagtttctaagatgctcaaatacaatgagaaatatatttgagcatcctgaattgtgtgaaagttttaaaataatatttgtcaatgttcaggagaaaaatccttctgagcatgtgaaacaagaggaagaccgaaggtagatatgcatagaaccctatccacagttactgagtatgtttagtagtgtagaaattgagaaaaactgccttatagagagctcagctccaaaatgactggcatgagatttaaactcagcatgtataggtcacataaaataatatcacactccaatcttagatatcatagaccctaaaagggcaatagtgcaaggtctttcattgcactgtcttgatatttctaagtcaaactgctttttgtttcaaggaaacacaacctcttgaggaagaaacttctgagatggcagctgccagagatatacaagctgcccaagtgaggggataggaaaagctgaagacaggcagacatgactgtgggtccaggctctacctcttggtagctatgtgaccatcgtcaaggtgctgtgtttcttctacccaagcttcagtttccttgcttattaaatacaatgagttttttttttctttctgacagagggggcagcaaagacaaaaaattgattacaagaaagggagtatctgaaaaactcggcatcgtgcctgacacgtagttaagtgctcggaaaataatagccataattattgttgacaagtctggagcaggaaaacaaacaagcatacagaacacaagattagactgtaggttaaaaaatacaaggtctagttctggctctgtcatttatttgctacataacctcagtcacatgtgttgttttccctcatctatacaattggagaattctacctattgtacctacttggcagcatcatatgagattatatagatatagatatatatagcactatatggtctaagggatcatttttattacagacttgatttgaaaaatgcagagttccactccctcaagatgaagcacccgtgccttgttctgcctgacagcctaggactgatgctacttgcagaattttagtgctctggttactgaaaacagtatcacatggcaccgtgcaaagtacagtgcccattttatggtcttatgaagcacacatgccaaagttgagagtttaattgaaaacctagcagtttttcatgatggctcacagtactttacatttttaaagaaactcttaataggttagcaacatggtgttttgttgtcatggttatcataaacatccaagtcactatcgagtgttattcatttgtaggttatttagtcaatcattctactcactattcttagagattgatatgatttaaagatactattgttcttttcaattcttgtttctgcaattaagatatactacaacattttcttacattaatgccaaatctttttaaaaatgtcagctttcttccaaatagtctcctcaaataatacgttaaggacttccagaaaacatggggactaccaaaccaatactcactctttatagctaaggaaaactgagctgcagagagttttagagatttatacaaacttctatggtgttagttgaagaatattagttgttcttgcctatatgttttcaaaggcagatcatgtcatccttgaaggtaaagtcatattttgttttgttttgttttaattcagtttacttcatagcatttgtatttaatataattaattcagcaaatgtcacttgtttctttatattgttacattttgttttatgttatccctggtaagtcattataaacttagttttcaaaataatttccacacgaacaattttgttatatcttagccatatccctttgaagaacatagtatagttatcactctattataaattttacttgccaaatgatgatattgaagttcaaagaatttatggccttgctcaatgtctcatggctagtaaaagaagatgtcagaacttaaatacaagtctctgacaccaagctttctctaatccacagaaagtgttatttaaatgaaaatattaattgcttagagaaagtaaacttgaagaaataaggaagtcagttttgcttggaattagaggtgataattttcattctcttcagagctctggttgcatgtgaaactaaactggattggaatcccattatgtaatttgaagtatcgttagtccttaagacactagacattgacatgtttaagcataattttgtaaactccattcagagtaagatataatgtaattgtttttgaattccccatactaatgcctttcttcaccagagaagttaatggtgccttctatatgtgacttatatgtgcacttcctcaaattatcaacaaacaactgaacttggcttcctcagtgtgaaaatatcttattgctttcaaaacattgcaatattacaactccaaaaaaatgtaattttgatcatatgcattttactaagaaataatggttattattatatttggttttatttattctgtattacagttaaataccatatagtaaatatttattcatatgctgcttcctcttaaacaggctttgagataggttcacatgtgcaatagattaataaaatataagtacacatgaaaaattgacaatggttgaagaatgatggataatgcttgaataaaagaggaaagaatgaattttctctaaattcagccattatttatgtattttataatcatagaattttagaacaagaagaaatcttaaagtttttattattgaatatctttttttatagctgaaaaaattatagacctaagcgttttgccaaatatcacacagtcaattggtaccagcaccaggaccaggacataagttattttttaactttgtgccagaacatccccaacctgacacatctgacttccttaataacgcattacttaataatttgactctactttcacttttcctttgtaatccccaaagtgaattacatgaccagaaagcagaagttcagaaagaatatatttatgatcaaactttgtcttcccttttcaaatatatttttcttattatttgcttaagcgagcacattgagtgaagaatagcatctagcagtttgctcattcaatgtgcattgccgatagctaccataaatattgtaaaccactgatacaactttttcttttctcattccaaaaaaggacataggcagggggagccgtgtgaatatcccatcacaccatggctggattattggctagtacaactctgagtccttctatctgctcccaatcaattccagccacaaattttatgctcattgaatccatgaacaagaacatcatcttaaaatattgacttatcagaacaaaataatcaatgactcatttaaaattattaaatctaaacttctttagcaaagctctacaaaatcaaaccctatgaactagtattgtaatgagggagggaaggtatgcatagggcaagttttagattttaaattggagaagtaagtgctatttgagggagattcagggaaggatccaatcctaatatcaaagtcagaggcatactccgtcatgacaaagggggacaagaagcaatggaggcaggatgcagtattgtcctcagaaaagaagcttgaacccatagaatgactcccatagaagaaaaaggcacaggtggaacttcccaaggactctcttctctacattggcaggccacctggcagtttctggggactgagacccaggtgctttagccagatggggttgcctctgggaaaatgcacacagaactgatcttactctgccttcctttctaatctccagggtttcctgaacaagtttcactgaatttttgatcagaagcagctttgggctgtttgaaaaaaaaaatctgttgatctgcatagttctttatgcaccattaaatagaaggcacctcagttcagtcttttaccatgaaaccaaacataccctttttaggtccatgttggaatagttctttgaccaaataaaaaagaaaggattatatatcaggttatgaacaaagagcatgtgtgatatgatagagacagattggtcagaaagtacacgctggcattctgaactggatttaggaagactgctgttccaaaatcactttagagactatataagcaaaacaataaattacaatgtaaaataaaaatattaacacttctatttttatataagataattatcatttaatgtagtataatatttaatataatagattaacacatattcattattcatgtatcagaaatacattttccaaaattttctctgatgggtgaagcatcaaagaagtttggagactgccactctggaccttctcttcataggctcatgaatcttgcagaactattcacttcaacattttagaaagacatgagcagattacagatgaatctgcttagccttctggaataactacggatatggttgtgaagccaatgtgagtttacagtaactagtcaaactgaggggccagaaagaggatgtgaaaatgccttgcttttcttctagaatatagacattcaatggataagaaaaaaataataaaaacaggaaaactgagacccagagagatatatttaaatgtctaagataacaaacctcataacaagtgcgtgagcatttgaattcagttcaattttttatcaaggcctgtgtcttgctgctacaacttgaagcatttgttcttttgtttatattatttacatgacataatagcctcttttctgtcctttcctttactgagtcctttccttccttcaaaactcagtccctcttttccatgaagccctactgatgattccagcacttattattcagtgtctttttccaaactccagacatgaactttgtttattgagagtttactccatgccagccacataggcatttcacatctcctcacataactctgtaagttgttgtggtaggcagaataatggctcccaaagatgttcacaccctaatccctgaaacctatagatacgtaacatgacaaaaaatttacaaattaaggcgatgtacattaaaacacacagcttatcctgggttatctgagtgggtccaatctattcacatgagcccttaaaagtggaagagtaaactagaacagttcatctgagatgtgacagaagaagatgcaggagagatccaaagcacgagaaggtcaggacccactgtaactgactttgatgacgaataaaggggcaataagcaaaggaatgtaggtggcctctagaagctgggattggccctcaaatgacagccagcaaagaaatggggagctcaatcctacaactgtaagaaactgaattctgtcaatatcccaaatgagcaaggaattggattctcctctagagcctccagataggaatacagccatgatgacactttgatttcagccttaggggccccaaagcaaacaagccaagacttttgatctatggatctaaactgtgagataataaatttgtgggtcttttgggctttttttttttttgagacagagtttcgctcttgttgcccaagctggagtgcaatggcacaatctcagctcactgaaacctctgcctcctgggttcaagtgattctcttgcctcagcctcccgagtagctgggattacaggcatgcattaccttgcccagctaatttttttgtatctttagtagaaacggggtttcattatgttagccaggctggtctccatctcctgacctcaggtgatctgcctgcctcagcctcccaaagagctgggatttcaggcgtgagccactgcacccggccaaatttgtgttttttaagctgctcaatttgtagtaacttgttacagcagaagtagaaaaccaataaagtttctatttctgggataaatcccacttggtcatgatgaattatctcttttatgtgttgttgaattcaatttgctagtattttactgaagaattttgcatcaatatttatcagacatactggtctgtagttttcttttttatattttgatgtatctttaacaaaaaactggctatagaagggacatacctcaatataataaaagccatatacagcagaaccttagctagttgcatactgaatggggaaagcctgaaagccttttctctgagatctggaacatgacaaggatgttcactttcaccactgttatcaaacatagttctgaaagtcctagctaaggaatcagtaaaaagaaagaaagaaagagcatcaaaattggaaagcgggaagtcaaattatccttgttggcagataatacaatcttatagttggactccaccaaaaaactattagaaactattagaattgataaataaatttagtaaaggtgttatctataactttcaaacaaaaattggagccatacaagagttaagctcacacaacttgcaattgtcagaattgatgctattaaatatgctctactttgaatgtgtgtgacacatggtttctctttctctttcacttgagagagataactgtatcttagatacattacttatctatcttctccatattatctggtgtagtcctggacacacagacatcccagggggtggacacttgatgtgcttcccagatcctccaacaatgaaggacttggtgctctaagaggtgagaatgttgtcagccccttcagagactgccccagctacagagcggccataaccaaccacacaccctccagagggttgcctggataaaatgaccgctccatatagaaggcctggccaagttggcccgagtctggacaacaatgaagggctctgatagcttcagagctccccatagggttggtggaggctgctattgagattactttgcccatcaacttctccctgctgcttcctgcttccttccccttccttcaacagatgtggactccatggacactccttaataaacatcttgcaagctaaactgcttctcagaatctgcttcccagagaactaatcctgtataatcccactgatacgtttggttacatatgtacatattgaataaagtttattttacctagtaatttgggtaaaatattagctccttgtcacaaatttccaaagtgcagagacggactattttaattgtgcttgcaacttttatctcatattgtatgactttgaaagttgttgagagcatattttataaataatctcgctttgggtgttttagtagtgtatgtgtagcgcataaattaggcagcattctcatacaacacatataacaggtactacagggacagaggaagatcagcatgtatcaacaaaaaccacacattttatgattaacacagaggatgatatggaaagttgagtataccctcccctaattttttccccgactctacaaccgtgctgtgatgttcctggctttgcgtgagttaacttacttgggagtaccagaaaagaaaagaggcttttcagcgtaggattgtttgtttatttgtttgtttgtttaagagataagatctcactctgttgcccaggcttgagtgcagtgacgcaatcatagttcactgcagccttgaactcctgggcacaagcaatccaattctcccatctcggcctcctgagtagctggaactaaaggcatgtgccaccatgcccgtcatgttgtttttccttgttaaaaccactgaagccatcttcctggtacccatgatgagatcactcctctacttgtcttcttgttgcttattctatcatctctgcacctcctgctttccaagaattcactggctactagatagccttctgctattttctagtatccttatgtgctctcaaaatatgtgatacataagcaaaacactgttaaccatcacgagaggttagattaacagcttctttcttttttgtagttgcaatctttcctctctccttctaccatttttttatttgtttttaatgaaaagaggcttctaagcatttattttcactacctcttcaagagccacaaaaatcaaaagtactaagagtaatatttttaactttaggagccccaggcaacctttcaaatagatgacaagcttacagtcaataaagaggaattttaaccacatatctcatggatacaatgatgaacacttgtccctttttacagtcaggaagtagaatcatcagacctcaagtcaaagtccacatttaaatcccaaacactcagcttcctatgacgcatgcagacatccttgccctttgaacatactacatcccataatagttgttttgcagtgaatgcgcatttcctggagaattgaggttgcctcctggccttccaatgtcctgtgcttcacttctataataggtacatatgcatgggcaaagctgttgcctttgagttttcactgcccaagctcaggcaggaacataagttatcaggatagcatcctaaaagcacctctatttcttcctgttggcagtacatgccagaaaactaaattttatgttgtttcatcttatttttggcaagttcattctgcaaaagatatatcttaacagtagccaagcacaagcaatcaaactcagacttattattttcttaatcccgcatcacccctcaatatggccattttggccagattaaccctgtgattacatgtctacttgcgttctgtttattggttattgtctcagtacatctgcaattttaagattcattacattatcttttgcttgtctctcctattcacctgtccgcagtctgtgtttcacctttgccctcacctgtcatcagcctgtctcccaaaaaaggccccaccattgttctgttgcaaaattctatttggtcagctgcctcattacctctattcaggtctttttcctctccccatatgctccagttctctgttcctggatatgctgggtataactggcactcactactgagtacaggtaccccttatatgtgagagtcctggaggcacccaaccaatctcactatggtcctcagtcaatgactgaaattgagctgcatttcttcatggagaagtgggaagaatacctctttcccaattttagcatggctgtattccacacaagcataagacatttatgtttgtgtctcaatcatttacaaagtttatagtgaagtagctcttttaggttataacttacactgcttactttccccaccacctattagcaaaagaatgagcccatgggacatttgaataggagaccaatctgagtgaaactatttacatgcagataggtaacacccaaaattcttcttggtaaagccaaatgctgatgaacagtggccaaactcattagtttagctctcttcccccctacccagctttaatgaggtataactgacagtaaaaattatatatatttaagatgtacaacatgataatttgatatatatacatggtaaaatggtgaccacaatcaagttaattaacatatccgtcacctcacatagttaccatttttttctttgtggtacaaacactgaagatctactctcttagcaaatataaagtatacaatacagtattaacaactacagtctctatgttgtccattacatccccagaacttattcatctaataactgaaagtttataccgtatgatcttagctctttcttttatggtaagtctcagactaggcctactcctgcgggagactagaggaaattcctgagcagaaagtggagtagagcaggtagatctgaatagaaagttagcatgaaagaagtcataggggcctaagaagaaggagcattggggaaggggacatggtatgaggacagaagcagaattatcatcaagagactgcaaagcacatatcagtcataactgccacagaataaggctcgtagtcctattgtggctatttacataggcatttctgcacataacctctgtcaagggtacatgttggctgttctcagcaccatcggacagaacaaaccattaccacttgcctctccatgtgtgaggacctcccagcagaaatactgcttacctgtgccatgagatttgtttagtaccccggtgctgtctgggtacctttctctaagcttcccaggaaattcctaaggtctggaaacacaggatagtgttcttgaccagtagtggtttcgaagagaattttcattccacttccagcctctgcatttgggtagaacaagaccacaataaaatgaattccattacacaaatattacttacaaattctgatccttcctgaagtgactgggaatattgtatttctcttttgatttggaaagagttgatatttcttctcaccaacctgcactaagttctgtttgaactgagaatcttttacattggcttttttttttccccaaaatctgaagtagtggttcttttgaccttaccgttaactgaaaggagaacaattggctataaaagtaagtgcagcgtctctaagaaatccaagtgtttagcaaatcaaatacaacataaggcactttaaggttttattaaaatctcatttattggcaagagttgcttctttctgaagagttctagtctgcctctcaagacttaatctgatgttttccatttgttttatagtatgttttttacccttttcctcacacagttctcatacctttatgaaacttttcccttatgactctacttcagtgtcgtcttcccagagaacccaaccagtgacatcctgaaagcatacgctgtgagctttgtgagagctgggacttaacggcagttttgttcagggctctgtttccagtgtcgtgctctgcagatgacataaagcaggcactggataggaatgttgaatgttgaatgaatgaacagcatccatgcttatggtcaacaaacctagtggcctctgagtatcatgataaagagcacttgctctggaatctgaccatgtgagttcagtttggctcatttgcttcccaggttgtaacattggatgagttcattaacttttctactcttttattttttcatgtgtaaaattggaaccatagttgtatccacaagatagtttttcttaaatttgtattgttttatcttgtttttgaagattaaatgaattgtgaagcacttaggagaacactgagcagatagatgttctgaattaaagtcaatgatactacacagtatgaatgtttatggtggcagagtgctcattatctgattaggtgattcttactagttttagaagttttcatttctagaatgacctttctgccctctccatcaatatactttattatagaagtctgctcattctctttaaaacacttaatggtctctgaaataaacttgctttacaaaatcaatatggagggaacttttccatcttgtttagtgttatatgcccactttaagaagaatagttaacatctaatagttgtttaataaatatttatttaaagaatgcattgagtaaattgtttaagttttatttttatgttatggcaaatttgacctcataattgtatctatcagttctatctcagctctgtggagcaaaagataatggctttaatgccttttattttctttttagctattcacatttttatttgttatttttaaaaattattctcaattttttggtgtacatagtagatgtatatatccttatggggaacatgtgatattttgatacaggctttaatgccttttctatatgacaatttattggacatttgaagaaatgatctttcctttatttctctattctttatgttttccttatgattgtgtgtgtggtgggtgggggtaggtaatggaagataatatgaatatagaaaaagacatagagaattcctaagatggggcaggcgtggcggcccatgcctgtaatcccagcaatttgggaggctgaggcaggcagatcacatgaggctaggaattcaagactagcctggccaacatggcggaaacctgtcttgactaaaaacacaaaaattagctgggcatggtggcacacacctgtaatcccagttacttgggaggctgaggcaggaggatcacctgagccagggaagcagaagttgcagtgagctgagaccacaccactgcactccagcctgggtgacagagtgagactctttaaaagagagagagagagagagagagagagagagagagagagagagaaaattcccaagagtgaatttccaactccaagagctttaaagtgtcatgtgaagtcactgaaggaagaagactttggagagtggtgttccagtaataatatccggcccttagaatagtctcctaaaccacagaaaaatatatgccagaagagtatctaattcaagaaagaggaagatatgtaacccaaaaaatgcagtcaggtctgccatacggaagcaaatagatggcatccatatggcagacctggagaggacagagggtctcaggggggaagatgtactagtcatttacctatgggtccttggctccagatccatattcctgtactcaactttgtgatgcttaggttaggactgtacaaattgtatttcagagacctatttttcagcactagagaaatattaggaggtaaaagaaggggagctgggccttcctatttattgctatttctgtcaatatcaatctacagtggcaattcgtttccacatttggcagctgaataaacactattgggtaaaaatatacacctgctttttaaaagtcattattagttaagttctccctatccatccgaatagcacactgttcaaagctcatacaccattgcaaagataattctaaaatttgtttggaaccacagaagcacctgaatagccaaagcaattttgacaaagaagaaaaaacatgaaatcatacttcttgatttagaattatactacaaagctatagtgatcaaaacagtatggtatgggcataaaaacagacacatagaccaatgaaacatactagaaagcctgaatatcaacccaagcacaaacagttaactaatttttcacaaagtcacaagaaaaacaaaataagacaaggatagtcacttcaataaatggtgtcgggaaaattagatacccacttgtaaaaggataaaattgaatccttatctaacactaaacctaaaaactactcaaagtggattaaaggcttaaacataagacttgaaactataaaattcctagaagaaaatataggaaaaaaaactccgtgacattggccttgccagtgatttatttgatatggcagcaagatctcaggcaataaaagcaaaaataagcaagagggacatcaaactaaaaagtttctgtatagtaaaggaaacagtcaacaaaaaaagacaacttattgactaggaaaaaacatttgcaaactatgtattttataatggattaatatcagaaaatataagaaactcatacaatggcaaaaaacaaacatgcaaacaaacaaaaccaaacaaaaaaacacacctgatttaaaagtgggcaaatgacctgaatagacattttccaaaaaaggcatataaataacaggtatatgaaaaagcactcaacatcacaaatcattagggaagtgcaaaacaaaacacagtgaggtcaccttacagttgttaagatagttattatcaaaaagattagtattggcaaggatgtggagaaaaggcaacccttgtatactgctggtgggaatgtaaattggtatagtcaccatgaacaacagtatgtatgttccttaaaacatcgtaagtagacctaccataggatccatctgggcatatgcccaaagcttatgaactcagtatgtcaaagaaatatgtgcactcccacattcattccagtattactcacaatggccaagacatggaagcaactaaagtgtccactgatgattaatggataaagaaattgtggtatatatacatataaatacacacatacacacaaatgttattaagccttcaaagaagggtgatcttgttatttatgacaacatggataaacctggaggacattatgccaattgaaataagccagacacagaaagaaaaatactgcaccatctcatgtacctgtggaatctaaaaaatgagtaaatagaagcagggtaaagtggttacaccagggccgaggaggtgggggaaatgggaatattctggtcaaagactgaataagtctagaaatctaatgtacagcatgatggctgaagttaataatactgtattatatactggaaatttgctgagagtagatttcaggtgccctaacaacacaacacacaaaaaggcaactatgtgaagacattaatatgtacattacttgactgtaaaaatcatatatatatatacacacgcacatatatgtatatatatatatacacacaccatgactgtatacaatttttattaaaaaataaagtagcaatatgtgggggagaaaggctcatctgctactagacaagccttccttacaaacatataggaaaataaaacaagagcttagcatatttagaaactttatgttctgcatgcatgtaagtatatatgtatttatttatttccttgtattttgattctaaataatctgagttggcaccaaatttgagagtttaacttcataaaacattttatttaaaaaacagagtccatattgacacaaattatttaaaaaacaaattaatgatggagagtagacaactctcccctgcagaagaattctaaataatttatgtaggtattccacccttaaaaaggtagagaataactgtcatcttaagtgtggactgttcatagtgacattttctcagggagcacagtatggaaagaggtggaaaagattaactttataatagtatgacaaacagtatttcagtgaagagattaaggtaaagataaacggttattagtcatcttgatcatgtgtatccttgatatactgtgatgaaaatggcacttcatgcctttggtcattcttccaaaataccataattttattctaattatgacttttttaaaaatcagtaaaacctcagttgagggacattatacaaatacctgacaagtatatcaccaaacagtcaaggttatcaaaaataagaaaaaaacaagaaaaaaaagttttacttatttattttaacttttatgtttaagttcaggggtacaagtgcagctttgttacacaagaaaaataacttaaaaaacaaggtcatcaaaaataagaaaaatctgaaaaaattgtcataacctaaaggagcctaaggagacataatgactaaatatatgatatcctagataagatcctggtcatggggaacagacaatgggtaaaatctaaggatatctcaataaactatggaatagaaagtttaatcaaaaataagttgaagtccccaaaaatgtttttaacaagaatattcttgcatttgtatttttgtccttgttactgtttataattcccctttccatgatcttttgttaattgatacataataattgtacatgtttatagggtgcatgtgctattttgatacatgcatagcatgtgtaatgcttaaatcagggtaattagaatattcatacctcaaacattgattacttcttagtgttggaaacatataaaatcttcttttctagctatttttaaatatacaataagtgattgttaactgtagttatttaccctagtgtgctatcgaacactagaattcatttcttctgttttgctttaaccaacctctcttgttttcccttctctctctctctctatatatatatgtgtgtgtgtgtatatatatatatgtgtgtatatgtatatatatatatatatatatatatatatatatatatatctcacatttaaagataatttgtttatgcattggtagacacttaggctgattccacatctttgttattatgaatagtgctcaaccaacatcggcatgcagatttctcctcaatatactaatttccttttgtttgtatttatatacccagcagtgagattactgggtcacatggtagatttatattagttttctgaggaacctccataccgttttctatagtggctgtactaatttacatttccactggtaggatactggagttcccctttctccacatcctcatcagcatttgttatttttttctctttttgttaatagccattttaactgcagtaaatgatatcttattgtgtgtttcatttgcattttcctaatgattagtgaggttgagtattttttcatatgccagttggctatatgtgtgtcttcttttgagaaatgtctactcggattatttactaattttgtaattggatttttttttttttttttgctattgagtgttggagttccttatatatttttgttattaatcccttgttggatggatcgtttgcaagtattttcttccattctataggttgtttcttcactctgttgattgttttcttttttcttgcacagaagcttttcagcttaatgtaatagcatttgtctatttgtctatttttgtttttgttgcctgtgcttttgaagacttttctaaaaaacttttgcccaggtcaatgacatgaagtgtttccccaatatttccttctagtagtttcagagtatcaggtcttcattgaaatcaagtctgtaattcatcttgattttatttttatatacagtgagacataagaggtctagctgatcatctcaatagacgcaaaaaagcatttgaaaaaattcaacatcacttcatgataaaaaccctcaacaaactaggtatagaaggagtgtgcctcaatatagtaaaagccacatatagcaaaccagtggctagtattataccaaatggggaaaagctgaaagatttttaccaaagaactggaataagacaagaatgctcactctaaccactcttattcaacatagtactggaagtcctcgccaggacaattagtcaagagaaataaataatgagcatccaaactggaaaggaggaagtcagattatccctttttgcagaaaacacaatacttttatattgaaaatcctaaaagccccaccaaaaaaacttttagaactaataaacaaactcagtaaagttgcaggatacaaaattaacatacaaaattggtaatataccaaccacaaagaagcagaaaaagaaattaagaaaggaattctatttatagaagctacaaaataatagcttctatttatttattattctaggtataaatatttctaggtatatttatacctagatatatctaggtatatttatttctaggtatatttacacctagaaataaatttaactaagtcggtgaaagacctttatatgaaaaaccataaaatgctgatgaaagaaattgaagagatcataaaaaatggaagatatcttgtggattgaaagaaataatattgtgaaaatgaccatactaccaaaatcgatctacagattaaacgaaatttctattaaaataccaatgatattcttcaaagaaataggaaaaaaaatcataaaatgtaaatggaactaagaaagatagcaaataaccaaaacaattttgagggaaaaaaaaaagaagttcatgaatgccttttgtatggtagatgagtgtgtttcctttcctattgacttgccacatgacttgtcttgactaatggaattgagaagagtttgtgtgcatgatgtagcttagccccattagaaccaccattaaaacagagaatatattttaggtctctatgcctctatgtctctatgcctttcctcccttatggggagaaaactaatctaaaatgaaagaacagatacaagggatcaaaataatcctggcagtatttgaatccctaaggccaggtctttctaaagacagctacattcctatccacaaatcaatcaatcagtaagacgtaagcaaataaatagcaaaaaacaacaaaaaagctatctatggagtgtgatggatatgtcaatttgcttgactgtaataataatttcactttgtctgtatatatcccagatattggttattcctcttgcctgcattccagagtgagaaaacaagtggagctgaactgagccaagtctagccaagcatcattgaactcattggagctacagccatatcgtagccttcatgtaatatgagtaagaaataaatgtttgctcttataaaacactgagataataggaacatttattattgcgacaaaagaagattaacacacttgttgataacttttcaaaaacatttagttcttgtaccgtctccttcataaaacttcctctaagtgtttctgtgactcatctatagtttccatatttagcaaataaaaatggaggactcaaagctggcatttaaaaatatgtatagctcaacttcctaacttgattataagctctttaaagtaggatccaatcttattcataacatccagcaatatatattggacttctactgttccaagcatttttattagacattggagatgtaatggcatgtgaaaataaacagaagttttatactctttaagcttttaaactactggaggaaacagaaattaagcaaataatcaacaaaataaatgtcaaagtgtagttctaaccaatgttatttaaagataccaggtgcatggtcctctgagaaactgtgtatgggagacctgatcaagtcaggaaggtaaggaaaggcttccctaaaggagtgaggtgatttctcaagttaagaggcagaaaggtcagacagaatagtccagcctctgcaaattccatagatggaagttagcaatgtgtctgaagaagaaagactaaagttgctatgagatgagattgaagaagtaaataaggacagccatggtatctccctaatgataaacgcagtcccacatgcttagtgtgtgtccaacaaataatcatgaccatatatggcttgacttaggtatattgaatgcctgtggctgataggattacagacagaaaaaacacatagtcgctatcttcaaggactctctctctctcatactctatctgctagaagctataatagttcagcaaccatcagtcatagttgagttctaagtgacaaaaagccagctgtcactgatttattcaaaagaagaaaatcactttattgactaatggaatacaaataaatattaaacaaccaagctacaggaaggataggagtgtggctgtctttagaaagacctggccttagggattcaaatacagccaggattattttgataccttgtatctattctttcattttagattagttttctccgcataagggaggaaaggtatagagacataaaagttaaaattgagagataagtatgaacactccagtggaaaagaggtagaaaatctgaagacgagtgaaattatggggtctgaaaagccaaaatacatttattgtttgaggagtgtatttaagagagtatagtaggtgaacttagagataatctagagttacatcatgataaacattattacctgactaaaggaagttaaacttgatgccaaaggtatctagtcttcatcattagttttcttaatttttctgggctaaggtattctcatttgcacaatgaaagatgtattggacatactttgctcagtgctgctttacttgaagaattaatctttccctacatcatgtggtgatggtgcaactgtgaaatatcaccactccatcacccaactacaggtataaccacatggctcaggggggacaatcaaagtgcttcatccctttagccatagagacttttcagagataagaaactaatctgagcaaggccattcagagacatattatgagatttgatatgagcatgtcagagaaaagggattttctaactttttgagggaagctgtaagataggctaatggctgcttcagtggccaaggaagaataaacatgaagccaaaacacaaaagaaagcactgtaaagggaaggaaagagagttatatctaagtccttggatctgtccatgcctgaagcaatagccactggtggacttcctagctgtatgagctaattattttcccttttttcttaaatagtatgagttaagtttcttaaaattaaaatatttttgattaaaatggaggtaattctttctgctcacagggttattgtaaagatcagatttataagaatctggcaaggctggtggcccatacctgtagtcccagctactctggaggctggggcaagaggatcgtttgagcccaggagtttgagcctgcagtgagctatgatcatcccactgtacttcagcctgggtgacacagtgagaccctgtctcaaaaaaaaaaaaaaaaaaaaaaaaaaaagaaggaaagaaaagaaaaagaagaataaatatataattcattgtaagctgtaaagagcacctgagtcattatttgacttttaacaaattcctttggccacagagaaaataataaaaacaattattctcatgaaatagtggtaagttatacttttcatgaaataaactacagtaatagatttttgcatatgctgtgatttggaatcataaatgatcctaattgcctctgtgttgggctttgtctaaatactatactttgtttttactggtatttgaagccagcaagtaatatgtttattcaaacacttgtggccaaatatccttaattactttctgaaacagtttctgaatagggagactggtcaattatttttctttaatatgattattataataaagctatggacatgtttttgcagtcaagcttcctcagagatgtttataatgattcaatcacaaactaaatctctatgtttcctgctttgttgttgttgttgttagggaattaggggattccctggtatagcagtgtctttgttacatccacttcctatcttacctcttttctgaaatatttcaagttctccctgccagtgcaccaggagtaaaaagtcctatttatattgttcctcactgtgtatgtcattgcttctatcatattctggaacgcttatggtaccatacttagattcaggatggccagcatttccagccattgatgacattattaagaaacagaatgataaactatggctgaatcatttacaatgctaggtgttcctggcaataaatctcttatgacaatgtatctgaggctgggcacgatgtctcacacctgtaatcccagcattttgggaggcccaggcaggtggatcacttgaggtcaggagttcgagaccagccacaccaacatggtgaaacctcatctctactaaaaatacaaattagctgggtgtggtggcacatgcctgtaataccggttacttgggcggctacgtcaggagaatcgcttgaacccgggaggcggaggttgcagttagccgagatcacaccattgcactccagcctgggcaacaagagtgaaactctgtctcaaaaaaaagaaaaaaaagaaaatatatctgatatattccagaaatgaaaactaccctcaatctgtctgtatccgatgtgtttttccctggtatttccttagtaagctgcctggatggaatgcgtaaaacaataacagcattgctttttcacgtaaaagtttgaaatcttcccttcaaatacaaaaatatttttcacagtcttttttattagaaagtcaccactgcagtgaggcgaaaacatacattctgagaagttacagtagaaatgacaatttacaaaacaaactgtgctatgatttgcataatgtgtaaactatactaaaccatggcatgcaacacaaactatttaagctcaaaatgttttaatgtcatcttattcagacccacactttccaagataaaaccatagataagtggctataccctcagtctgaactcatgtgtttcagagaaaagactattacctgttctactaatttccctgtttatcgattctgaacaacacctgcccagaccatgctcactaactttattctaaaaccactttgtctgccttctcccgaccaaaaaacctagcagtacctttccctaaattttccccatgagaactatgggtactctggtaaatgttctgttttcccttgttcagtcaacttaataaactaagttttgtgtggttagcagatccctgatgatcttttcatggaagcttgtgtcattcacacatgatgacattgctttcttcatcatccatcatggtacccacactgtgttctttgctcctagaacttaaatacttggccctagggatatatttgtctcctgttagatgttgaacaggtatctgagaagagataaagactaggtacttattcttgttcaaactcagtatttattggctgactttatatctatctaaggacagtcaaaaccgggtggtagccaaccactttgcttttgagtgatgactctggttctgcagaatctatgaaattgagtcacaaaagacaatgatgtgcttatattctcaatcactagactctggtttttctttttcttatatgatgctaccaatgccagaggctgaaacaaggacaaatgtgcagaggttgcatatcgccacacagctggaaaatggctttgacaagcacacaaagtattcttgctgtggataatttcctttcaacataagtaatatgtgtcctccatcatgacctgtgtgaggttggactacatgattgttaggtctcttcaaacccaagactactttatgttataaaaatttcaaagtaggtaaactttggccttagtcattattcagcccatcttttttccctgctcttctgacattgcttctgtttgctacctttcactagtgttcattgatggttttagtgtattcatgttgtcctcatttacccaagatctttattttaggcctgttgccaagagccaaacttcattctcacacatgtgattttatttcctgtgttagaaccaaaacaatcagaattcagtttttaatagatgaaagttacaactccaaaagaaatttgacttcatcaggaccttcctgaaagaaataatcactgaaccaaaaaatggatgtccatgtatcatttatatagcagttgcctaccttacatatacagtatatcaggttagagctgtgcaatagtattttataatttacattatgagcatggatcaatggtagagtcaacaatcctacctttcaatctgttgcctcacaggcatttgttggacacatttaaaaactagctgacttatattaaacataattgtgtgctaaactatatatttggccttcttatctcattgaattgaatgagataaatctagaaagaaagattttataactcccattttgtaggttttaagaagttaagtaacttactctatatcacatatttggtaaatgttagactttgctctcaagctttcaatttggctgagtaaataacaatattcacggaacagttataaaataacatgaaaacacaaagcaagtcacaaggcactattaattgcacccacgtaatttgggaactctattatcaattttctgaattaaaataaaggaggtattattgtgagatggactgtatttagaaagcttcctaaaagagatggataattacactgggttgtgaaatatgtacaatggcagaatgtttgtcgaagggaggaatttcagagaacacaggaacaatacattattggaaagagaaactagtaggagcactgacagattatcaaattaccgagaaaattttcaatggctagtgaggccttgaatgagggataggggagggagaaatcaaaactaaatagctattagtgttgagggagctgtgaggtggaatttgtggccacactcccctttccctccatgagccacttggtctataaaaagactggcaactaaggtttattcaagcggaattcattggtatccacactaagagttttaaaagccacattgtgacatacagagaatttggatggatggcctgacaacaggcaaacatcaaggaaatttatttgtttattagttggtcagttagtttgtttgtttgaaagttgcctttctctgtcttttgacagataaaaagatgggaacatatataactgagagtaagagaaagaaaaaattaaaattcgcctacaatgtggatgtggtaaatgagaaggaaactgatatgttttaagtacctaatgtgagccagaaactgtactatttttttttttacacattgattcacttaatccccataacaaccataagaagtagatgttacttaaagagggggcactaaaatttaagggattttttttttttttttttttttagttatacttcaagttgaagaaagaatttacagaagtttaatacctggcctaaagtcatatagttaataaaaaataaagtatttaaaccagttctcactgatatcaaagtccattgtctctcattaaatgaatctcatatttaaaaaaaaaaaccttaataatttactgagatgaagcattcttaggaaatttaataagcaaaatattcagataaaaattagtatttaagtcaagcatttctgtgcaacacatcaacccaataaagtggtttaaaacaacaaattttctttttttttcttttttttttcttgaaatgaggtcttattttgtctcccaggctggagtgcagtggctctattaccagaaaggggtcctgagccagaccccaagagagggttcttggatctcacacactctatgactccatagagtaaagtgaaagcaagtttattaggaaagtaaaggaagagagaggggctactccataggctaggcagcagcataggctgctcagctgcttatacttactgttactttttgacatatgctaaactagcagtggattatttatgagttttccaggaaaggggtgggcaattcccagaactgagggttccacccctttttagaccatacagggtgacttcctcatgttgccatggcatttataaactgttatggtgctagtgggagtgtcttttagcacgctaatgcattataattagcacataatgaggagtgaggacaaccagaggtcacatttgttgccctcgtgattttggctggcttgggctggcttctttacaatatgctgtttcatcagcaaggtctttgtgctctgtaccgtgtgcggacctcctaactcatctgcaactaagaataccttaacctcctgggaacgcagctggcttcagccctattttacccatcccctattcaagatagagtagctttggtttgatcgcctctgacagcatgattttggctcattgcagctttgacttctccccggctcaagtgatcctcctgcctcagccccccaagcagttgggacaataggcacatgccaccacacccagctaatttttgtattcttcttgtgtgtagagatggggtttgccacattgcccaggctggtcttgaactcctgggcacaagctatctgcctgcctcggcctcccaaagtgctggattactcgtgtcagtcacagtgccctgcccaacaacttttaattatctctcatgcttctctatcaattaggtcctcagctgagtcgttctgctatattgcatcagatgtcagctggttctgcagtcatctggaggctctgctggtagaactcccagcacacttcactcaaatggctggctgcagctggtgctagttatggtctgggatctcagatgaggctgctaagccgaatgtgttgttactcctttacatcgtctctccacatggcttgaacttctcacagcatgcctgctggattcgaagagatggcattcaagtgcttaaaaatgtaagcaaatctcttaatattcagtcttagtattacatagggcttctactgccatattctctggttgaaaacaatcattggatcagcccaaactaaaggggtagagaaagaaattccacttctcaaggaaggaatgacaagttttgggccctttttaatcaacatccaagtaagctgcttgtgatgaaagtgaaggtggggaacggaaaaagtgggaaggtaaagatcaaagcaaaatgctccagagtccttaaaaagctaaccgtgtaagcttggattccaagagagagactccagatggagctaggaatagaaagatttcctagtaattgggagcaaggtagatgaacatttacagtttctcctaatttctgtagtcaggcttcaggtacaaacttaggctaatatgttgtctgttaattatatgtatttcttaatcatatattggctgaggagataccttgggagggttgagagggaagataactgagagatggtgatattgctaatactaccgatatacgggacccctctgcaattacatcttttagttaatttcatgtgtatatattcagccattgacagtataatctgtatcctctgtgggtaggagccacagcactgtatttatttcgcattctcaatcacgcctacagattcagttcattcagactgttgtaaaaataaatgcggctcaaaaatgcagctcccccatgtaacctcctaggcaaaaagagacagaataaaatcagccaaccattttttcacaaagattgctgcctagtaatttcagggaataaacttttagttaataccgtaagtgcagaggcctgcagcatacacccaggtgaaaagtttcaccccacattgacctgtcttagggagaggcaagcacttgctgaagaagcaagttctcattactaattagtaattcattattgcatggtttcaagggaaacttatgacctgttaagactaaaaatgaacacaatcattaatgtttccatcactttggaataggaaacaatttcagtctaaagtgcatgatttctggaatgtatttctcgatgcttctgttttttgttataatatttcttgaaagcctggttaaaaaaataaaaatagctatgtttagcctaaaatgattacttttctctgccattgacaatgaggtagcatttactacaaaattggcattacatgttctttgctatgaacataactttatttgaatcaaaaaagtcaagcaacaaaagtttaaactcatttctttgaattttgacaagggtgtaaaactgggataattttcattaaatgtgttatacatttagcagagtaaaagcaaataagtatttattcactactgagaaaattacaaattataatcatgtgggatcctaacaccggaatagaaaacaagagaatagattataagaaataataagaaaaacaattgggattttttcccccagaaatctgggggcaagtgttgcaatgagaaaacataaagttactgattattgtattttattgtcaaatatcatcttaagtcatattgaaaatgtggccatctgttctccagtgtcttcaaaatctaagaatagcccaatcccaatcctttcaaaaacattctaaaaacaaaggatgaaaattatttatattggtagagatagatattttaattgaaatcagtttataaatatataacatttgataaatctgaacacataaaccatttttaactattataaaattattgatttctgcctccaaaattccagtgaaattgtccctaagccactaatcccatggttctattggtttatggcctgtttgagacattttgcttctcttttccactccctcttacaattttttattcccttggctttgtgggcacctctatgccctggtagttttcctcccctctgattgcgttcatctggaacgcaatcctttccctctcccacctttgttccacatgtctgtttcaaatcacccattcctattaataaactcattataacttttgaatctcagaatctccatccctggactatctgaaactcgccattttaaaattcagtacattatcttcttacaaaaaatgttttccatctccttaattaatgtacctatatagcggcatcaccattttaatagtctccttggaaagaaatctaagccatcgaggtgcctctatcctctcccttctatgttactgcatccaatatattaaactctcacaattcagtttctggcatttgtcttgaattcattctttcttctctgaccccatagggtgccagccctccattcagtctttttcctcaacaattctgattattttttctgtgtctttgctcccaaaagttgccttttttatcatcttgggagcttcctctttataatatgtacactaggacataaaactaaataaaatctctccattttctaagaaaaaacatacagattccatagaatccgtgcaatagctatcagtcacctaattgctagtttcctctcctaacactcccagtcctttcacctttgttatctaacattagaggaccatgccaactgaagcctatctccatgtcaatgtacatgatttttcttcctcctgaaatattctaaaattttcccacctggtaaatttcagattactctttaagacccaggtgaagtgttgttttatctgcaaagagtctcttaaggaagttcattctctcctatttgctataatattaatttgaacatttctttattattacctgatgttgcattgtatttatgaaggatgattgtatgcatgaaggattataccactaaacttcagcttcttgaagaagtagtccatttcttcttgatctttatattaccagtgccacaaataagcactaagaatacttaaatgagttacttgcattattttgcataatgcactttagtgtttggcaggcctatactcaaagctcactctgacacttagttgggtgattcaattacctaatttctcaaaatcacatttgcctcatctgaagacattggtacctacctcacagagttgttgtgagaactaacattatataatgcatgtgaaatacttagcatagtgtctgacacttaataagtactcaataaattctgactgctactattatagggcttcagttgaatagaaaaggaagtagagacagatgaaatagaatggtttgggataaaattgagaagtcaaaggaatgaaagcttaattaatttgagtgatcattttggtagagataaaggaatgagaataactggaataaaaggaggttgtagtgagagagtgttataaattattatattctgtcagcagtttaatgttctgctctagagcactgcattttgatgacatgatccaaaatactgtcataagtaagggtagacaagatggattgtaagataatcagagttgaggtgaacaagaaattaaatgttgtgaaatattattgttcaatttggaaatgtttatatttggtgattgccatagaaatttcagatagtagataggccttgagttaagaggaatagtgtgaatcagtcaccagattctttaaaatatgttcaggagtgaccaagaaattggtaaagaacagtgacgtgaatgggataaaggatgacttatacaaggatgggagtacaatgaactggaaagttagatttgtgactcaatcgtttgcttttgtgaaacaaggcatatgggaggatggacactctctactgtaaagcaggggctgatcaccaaggcccttaaatctggcctgctgcttgttttgtaaatgaagtttcattgaaacacagcaacactcattaatttatacattgtctgtggctgtttttgtgctgcagtgtcagagttgattaattgcagcaaaaaccatatggcccatgaagcctaaaatatttactatgtggccttttatagggaaagcttgcttaaccatgttctagaagtttgcagccaaatcagtgtcttctaatatatgctagggtataattaatgcaaggaattagaaaagaattttgtgtctagttgagaacatgaagaggagtttaccacaaacagtggatttcagaaggtctggtgaattttaagagaggtaagaaaggaagcaggagaaattgaatgtgtccaggaggagcagcattgagcaatatgagagtggctcctagaaggtggtcaaactgaaaagcttatctttggggcagtgactaagaatttctaagcataactaaagaggcctaatgacacctaaagaatcatggtgtcaggttctataagcgccggtgtaagctaatgcctcaggtgatgccagatacctgacaatacaaaattcgcccacccaataatggtgaggccctggttgggatcctaagcctggggacattactgcataaatagaagtaattataccaaaaacaacttaacacccctaggctacaagtccttgtatatcccaaggattgctagaccacaaaccaaaaatgaagacaatcattgtatatgagcaatctatcatttcatttcacagtatagcatctagatagatagatgagtgatagaatgatctctctctacatgcagaaatatatatcaatatatgtatatacattatcttatctatctttagtcattctttttcaggtagagaattctatatgggggaatttcaatgctcaattcttgaactacacatttttacttaggacaaaggaaaataggctgtactttttagaatataaaatattcatcgtttcccaataagcattatagttaccacagcctgcttaaagttgttcattgttaactgacattcaaactgtttggatttcaagtgaattaaactgtcaaagctcagcagtatatttatcatctgtgctacacacacaaatttatttaccacacacttcaaacatctgttactacattttaatagtagttgttgacatgacagagtaaaaaagtaaaatgagtccatttaaaaggttgattatggtgcaaaactggtaaaaatgtcatgcatgtgtatatccttcaaagatatctatgagcacagggaatgtgatcaggggcagcaaatttaaatccagaggtacagaaacacagtgagcaaccttcggtgatatataaagactcatatttagttttcatttaaggcctagataattcctgaggagaaaatgacaatacaatgtaattctcttattgcaaagtaataagagaaatgaatataaagttctgcctgagggaatgagaaatacttcacaaagaatcaaatttttatcctaagaagaatgagtaggaattcactacccaagaggagagactgtgtttggcttgccttactgttacgatagtaacagaaggaaagtaagaatgtgaaagtcaggtaatttttcaaaggcatcattgattttaaccattactcaatttcagatatacattcagttgtgtgttgatacaaataattatttacctatcttttattggttgcattcatttatccattccttttaaaaaatatttattgaaccactgccatgtgcgaagtgcagtagtagtcctgggtaaacaaagatgtgaaccttggaacgtttactcaggtaaaaagacagaccttagagggatcagtgcaattcctggagtaatgttaccacagagatgtggtaatgttgtaatgtgtaatgttatcacagggatagtaatgacagaagtttttcccattgctaggtgggaaagtcttaattaaggggataacttattatagcaaatccacaaaagtataatttttgtaagaaaattttttatgctctttttaggataaatctttgatagtaaccaggctgacagacaaggcaaggaaaactttctgtttgttgccactggaatggaagcaataaagatttttcaaatatgttgcatagcatttcaatgtggaaagggaattagtttagctaatccattttacttttaaagagttataagattactgcacttatcccattcaagaaagaaattattgctgacctctaaagtctcttccaacactgacagtctgttagttaataaccattggaaatgttaaaaataaacaatattaagtttcacctgagtttatgcagtgctgaggacaacgctttttttttctcagacattagaatgggttgtggcagaaattcctctcttatttctccaagacatcttatcatatttgtaaaagtaattaacttcaagtacatattttctgatcattttggccattgtttgtaatgtaaaaagataaattatactgctatgctagtttgataaggcagaataaaagaagtggtgttattgtgattgtgtatttttaattttaaaatgtagattattttaatgttatattcagtaatatttttgaagtcgcttgtatgtgactcagttatttatagcaggctgggaccagacctagaacaaaatcttcctatataggaggaacaggcgctgcttatagaaactgaatagcagatgctgaggggaaggacagtctgaaggacagaatgcagtattcagagcagtgtcctgataaggaggtttgaggagggcatagagacaaattccaacagcagcattcaggattccaggagaaacgcctgaaggacacctgtcagcaggtagctcactggattgcaggcactggcctgagtttcaaggttaaactttaagcagggaacctggagaagcaaaataagccacagtcttagagaagctggggtcacagacatgtcacaaagactttttaggcacaagaaacaatctaaatatccagttaccaggtctagtatattgggaggacagtgagttcaaagaaaagcagtagttcaaagacaagttttgtggggaatagataatccttgcacactcttggtgggaatgtaaattagtgcagctactatggaaaacagtatggagattcctcagaaagttaaaaatagaattatttgatccaacaatcccacttctgggtatatattcaatgaaattgaagtcaggatcttggagagatatctgtactttcatgttcattgcagcattattcacaatagccacaatatggaaacaacctaaatatccctcaacagatgaatggataaagaaaatatggaatatatagtgtgtgtatacatgtatatgtatataaaatggaatattactcagccttaaaaagaaaggaaatttgctatttgtgacaacatgtttgaatctagaggacattctaagtgaaataagccaagacaaacactgaatgaccccaacttttatgaggaatctaaaatagtcaacctaatagaacaagagactagaatagcagctgacaggagctggagggagggagaaatggggaagtattggtcaaagggtacaaaattgttttagtcatgcaagatgaataagttttggatatctactgtacagtgtatggcctgtggttaacaatgctgtattgtatacttaaaagtttgctttcatggatagatcttatgtcaagtactcctgcaaaagaaataaaaaataaataaaggaaacttatggagatgatagataagtttatggcatagattgtggtcatgattttatgggtgtatagttacctccaaacttatcaagttatatgcattaaatatgtacagcattttgtatgtagattatacctcaataatgtgggtattttttaaaaaaagcagtaatatatttattaggggcttagtctctttgaaccatgacatttcaattccttcccttgtcccttccctatcaacaccagatgtctgacgtggagggttagaagagtccaatcagaggtaggaagtcagtggttattagaattgactcagatttgagtattttcaaaccaatatttctaagttctcaaaattatattaaaagtgtttaagaaaaacgaaattcaattattcattaataagcatttatagttcttacactgtgtaccagttatatattaagtgctgaaaataacaagatgaataaaacatgacatctgtccttgagaatctcacagtctagaggacaaaaggacctgataaagtgtaatgcagtaaggtaagttctattatcacaaaactgaagaataaccttgagttttttaagggctagctcttgctcagaaactcttaatcgttttactatctccccatctattgctaactgaaaaaggactatgctttatcttgctgtcaatccagcacatgcattatccacatctaccatttccataagaattctcccctccacttcatactcagattcttgtgatctaaccaaattactggcttacctgtcaaccctcagacacaatttattattttctgcacttttatttgtgcttaaggaatttctttcaacctaaaattttcatcttttcctctccatttttcaaatccactgaaggtcatcaaaaatattgttttctccttggagtgtttactgaattctccagacaaggcaatttctccttcctttagactggcataataaattccatgtttcacaggaactgttcatagacattgagcagtgactagagttacacttcaattatttccattcaaaccctatcatagaatcataatttagggactctgtgcaggaaccatatcttggtgattattttgtatctgccttacaatacctaacccagagcctaatatatgataagcacttaaaaaataccatgaatgcttcaatataatataattccccaaatagagtgagcctccatattcccaatgagaattttactaattaaatgattttgcccaagaataatatacattcacttatcagtttaatgtttatgaggttatctaataactagttttaattcttagtttattaaattagttacatttacatatttaaaccgcatattttaggctgagctcagtagctcacacatgcaatacttgcacttcaggaagtctagggaggaggatcacttgcatgcacaagttcgagactagcctgggcaacatagtgagacctcatctctacaaaaaataaaattagcaaggtgtggtggtgcgcacctgtagtcccagctctttaggacgatgaggtaggaggatcacttgagcccaggaggtcaaggcttcagtgagctataatcatgccactgcactcagtctgggtgacagagtgagaccctatctcaaaactgcaaaaataaataaatagtatatcttttcaaataacaaaattattaagaaatggcatgttttttcatctcactcttaatacatgatacaacttactcaagctcttacacaaaacccgctcatcaagatctttatcttctctagagctacatttaaagtcctcgtgatcatttcccaggatgcaatctaagcgttttttgaatatgtgattcttatagtctttggaaattttatttcacagacataatcaatttacatatcttctaaatggtctttttttttttcatttgaccttggagcatttactgaattctccagacaaaggcaatttctataggtgtatactcataatatcaacatcatatacatctacttcatttttgaattaattggttttatttcttaaagcagcttttgttttacagaaaaagcgagtaggaagtacaaagttccctataacccctcactccctacagtttcccctattattaatctcttacattagtatgataaatttgttacagttgataaaccaattttatatattattattaactaaggtccttagtttacaggtaggttcactcttttatgttgtatattctatggctattttgttctttaaatagacttttttttttaaagcagttttaggttcatagcaaaattgagcagaaggtacagagatttcccacacactctctgtccccacacgtgcataacctccccaattatcaacatcccccaccagagtggtacattcactacaattgatgaacatacacagacacaccattatcacccaaagcccatagtttacatcaggatttactcttggtgttgtgcattctatgagtttttgataaatgaataatggcatgtattcatcacagtatcctacaaaataattttaccatcctaaaacttccccgtgctccacctactcctccatccctttcttccatgaactctagaaaactaattatctttttagtatctccattgtttgggctttcccagaatgtnnnnnnnnnnnnnnnnnnnntttcccctattattaatctcttacattagtatgataaatttgttacagttgataaaccaattttatatattattattaactaaggtccttagtttacaggtaggttcactctatatgttgtatattctatggctattttacaggtagattcactctttatgttgtatattctatggctattttacaggtagattcactctttatgttgtatattctatggctattttgttctttaaatagacttttttttttaaagcagttttaggttcatagcaaaattgagcagaaggtacagagatttcccacacactctctgtccccacacatgcataacctccccaattatcaacatcccccaccagagtggtacattcactacaattgatgaacatacacagacacaccattatcacccaaagcccatagtttacatcaggatttactcttggtgttgtgcattctatgagtttttgataaatgaataatggcatgtattcatcacagtatcctacaaaataattttaccatcctaaaacttccccgtgctccacctactcctccatccctttcttccatgaactctagaaaactaattatctttttagtatctccattgtttggtctttcccagaatgtcatacagttgtaatcatatggtatgtaggtttttcagattggcttctttcacataaaaatatgaaattaaggttctgtgtcttttcatgactggagagttcatttattttattgctaaataatatttcattgtatgtaagtgctgcaatttgtttatccattcacccattgaagtgaacactcttgactgtttctaagtcttggcaatcaggaataaagctgctaaagatactcatgtgaagttccttgtatgggcatagtttttcaaagaaatacatttcatattacaatgtaatatatacaattgctagattatacccacaggaatagttatgaaatctgatttaatgtgtttgcatcttttttacacatttttcctgttgacctcaatatatctttgaattcaacattaattgaggttgtttgtggctatggaatcttcaccttggagtcagaaagtttgtcttattaactgattgtaccatttacaagctatattatctcatgtagaataatctttccatatattagtttatctatatgtaaagtgactatattttagggttgttgagagtattaatggtaaattgtagctatatctattagaaatgatttaaataggccaggtgcagtggttcatgcctgtaatccgagggaggcctccttagagaggctgaggcaggaggatcacgaggtcaagagatagggaccatcctggccaacatggtgaaatcatttctctactaaaactacaaaaattagctgggcgtggtggcatgcacctgtagtcccggctactcaggaagctgaggcaggtgaattgcttgaacccgggaggcagaggttgcagtaagccgtgatcacgccacggcactccagcctggcaacagagcgagactctgtttcaaaaaaaaaaaaaaagatttaaataataacttggaaaatgatgcacatgtaaaaattccaagcatatacttccaaaagagcaagcttggattgtctaactcaaaaaaattgacatgagccacaaaaactcacctcctagggccctaagaaaacatacggtattggatacctaaaaaatccaaacctcaccatgcagagttccacaaaattgacagatgtgcattaatatataattttaaactttgccttagaaatatgcaatgtactaattacaaaatcatacacactcctcaattctcagagtattgtaaaatctttggaaaagtaaaatttactggatttgtttttatatactttattaatatataaattaatttatgtacatatgaattctttcattaattatttcactcatgtactccaaaagaaattataaactaattgcagaggataagacatagctggtgacgtctagagaagcagttctgtgttgcagaatagaaaaaagtttttctctgtagccataatgagctggagaggagctgaatcccaggtcagtgattaactagctatataaatttggcacatgatttaatctttctaatctcaatttccttctgtgtgaagttgagataatatttcttatctttctgggttatttgtcaaatggcaagcaatatttgtaaagttcctgattcataataaaagatcttcaaatagtaactcttgtttggatttccttacctaaatcctttatctgagccctttccagcattctatttttcagcaagatatgtaaatggcttaagaaaattggctcatacattagatatttttaaatcaagttttcctgtgtatcctgtgacttaatcttctagatctatcttatatatcatcattgagaatgaaatatataagaatagattatcaaaactacagaattgtttttatattattgaaatttaaaatatttgggtaattctctatgctagtaaaaaattaataatataaatcttccatcatatcccactgctgcttgagctcttttacaaaaagtttttgaaggagataaggtgatattattaataccaccttgcagaagaaaagaaattgggacccttaacaggtaaaaggatttaatctaagttacataatcagtactggatgtgctgacaagacatctcagcctctggcattcttcacatgttatataaatggcatagtattgggtctctaacttttaaatttaccaatagcataattttgtgtatatatgaagttaaagaatttgttttgaaacaaattactggtgttactgtgattgcagagttgctactttttaatcatatatagctccattacataaccaaatgttcaggaaatatttgtaaaactaaaaaaaaattcttactctgtatattaatagaaatgaatatgagattatatgaatgtgacattaaagattgaaggaatgtcctataagccaaaagctttttgagaaatactcaccatttgcctggaaattgaataatgtcacactaaagacaaagctggattgtgtccccttggcattaactatatggcgttaatggcagatagcatgtgaaaatgtgagcagacagttatcataagggatataaaaatataagaagaagctagatttaaataacatttctcaagaaaaatatagccacgattaaaatatagcttttttatcgtatgatttttaagatttctcaagtttaaagacacagaaatacaatttaaatgatctcagggaaaaaagtaatttattggaaggattctaggtcatgttatggaaaccaaaccagaaaaaagagagggctatatttgtaccccagggacactggatctagtgacaggtagtgaacactagaactcacatgacatcagggacttgggctttcatctctgctgcttcttgaatgctcacattgtttttcccttccttttcaaactttctcaacttagcagtaaagttgactacaagcagttttaaagttgtacacctttcaatttaacctccaaagagaaaacattactaactgctgctatctctggttccaagtccaaaaactgcagagaaggtaatcatttgttcagcttggatcatgtgcccaaaactggacaaacagttgtggccagagaaatacagtcttgttagcaacatggagcattcatagacttatggactgttataactaggagacacattaaacatcacttttctaataattttgttttagagattaatgaactgtgacaacaaatgttcagagacttgaccaagtgacaaaacttgaatttgaataagtatctagtgtttttgtaatgcttaaagttattaaaaggaaaataaaaataaatgaagtaggaagagaaggaaatgaagtagaagaaagaagaaggaggaagagagggagaaggaaaaagaaggaaagaaggaaggaaggttgaaatggagaaagaaagtaaaagggaaagaaaggaagtaaaaaacagaaacaaaaaggggcagctcctactgtaattttattgatggagtgagtgggagaagaggttatattataaagtggctggaaaacaatgccatacttgcccattatagtctatgaaccatgacttacgtagtatatatagcaagtagaataaatcaatgattatatttggcttaaattgtcagattattttactcaatttctctcattttgcaatagatgtgctttcccattttgatttttcactcatcttcccttttatctacagatctgtaggctgtttcttataaaacagattcctgggtgaaaaaatttcttggcatcatcacacaaaaaaataattatttggttctgcctagtttaaaatatcagtgtaaaattaaacacttactacaatgtacctccatttcttaataggcactaagcttcattagaaatgtaaattgagcttttacaagcaatatcttttttttttttttagatggagttctgctcttgctgctcagtcgggagtgcaaaggcacaatcttggctcactgcaacctctgactcctgggtttaagcaattctcctgcctcagcctccagagtagtggggattacaggcacgtgccaccacggttggctaatctttgtatttttagtagagacggggttttaccatgttggtcaggctggtcccaaactcctgaccttaagtgatcatccacctctgcctcccaaagtgctgggattatgggcgtgagccaccgcgcctggcctcactagcaatatctttaatgacgccttggtatactaggtaactacataaattattaaaacacagccataggaaaatgtgtctgtcttcatccagattcatctctaaatgtatgaatgtttgagatagcactattgatgtattgtagtattttctttggggctatctgagtaaagtgaataatttgtttaacaatgttgactatttgcctactaagtgccacgcaggtacttagaagtggaacagaaaataagataattcttagagatctagtccagttgagagaaaaagccttgtaaaaggtcattatagacttctggtaatggcaaactgaatattttgaaccagacttcctgaagagcataacaaagagctaaacaaaatatatgaatcattttccttatgtcatcttataactaataaagtaggaaataattatggcttcaatacctggaagaaaccagaaatctagagagaagagcctgctttttggaatccttctgctctgtaggcattggcagcccagaataggtatccgacagattgggcagtactttgggaagattcctgggtccatggaaaattgccttggaaataaatgtcaccaaatagtgtggctctggtaaatcccttgagaatgggttggaatcagacaagcgtactctaggtctgttacaggtagttagacaggcatgagcatggcaggagagggctgttcacccctacccactagcaatgtcaagtgatggtttgacaattatcacactgcctctctaaaaatgataatttggcagcctgtgccagggcatcagggagagacaacctccttaccatccaaagctattaacattaaagtgttaaaattatgcagcagccaggaagaagcaacttcccaggcatatgcattaagaggcaaaatatcagagtatgaccttctggggcgactccaccggaaaagggaaggaatcctcagatgggcatgtgtaccacttcctaaagacagtgcacgtgctcacttcccaagcgtaaagagggcactgcgcatgagggcagctccccctaagggaagaatcacaaaaaggggcataagatgccagcctacaaagtcctaggatgacagctgaatgcgacacttgttcttcaagtcgcccacttggatctcttccaagtgatctttcctttttttcctgttctaaagcctttttaataaacttccactcctgctctgaaacttcctctttttctgccttatgcccctaaattgaattctttcttctgaggaggtaagaattcaggttgctgcagacccgtacagattcgcagctggtaactcagatatctgccaccagtaacaggtctaagagtgcatcagaagcaaaacagctattaaaagtttgagtcatgtgggcgatctcggctcactgcaagctccgcctcccgggtttgcaccactctcctgcctcagcctcctgagtagcagagactacaggcgtccgccaccacgcctggctaattttttgtactttttttagtagagacagggtttcactgtgttagctaggatggtctcgatctcctgagcttgtgatctgctgcctcagcctcccaaagtgctgggattacaggcatgagccaccatgcccagccaaaagcatcagttcttaaagttgggttaaagcaaaataaatgataaaatatgcaggtaaatttaaatgaataccgactgcaaaaaataataatatattgtctcaggggtcttataatatgtacataattaaaataaattttaaaatgcatatactttgaaggaaaaggtgttctgcagtgcttgcattgtctgggaagagagtatcaattaattctagtacatgtttctcaggaaaaccagtgaactatagtaaaagaggaataaatgctgagttaatttgggggaaaagagaaaagaattttaatatgaaagaaggcaagaaaagagattataaagtataagactacataagacaaatagaaaatgtagagcaagattgtagatttaaagccaaatactaaaaatatttaatgtaaataaagacagttgttatctgcctagacaaaaaacgaaactcgattttacactatttaagagatatatgtaaaaagaaaatacagaaaggttggaaagaaaaaagataagaaagaagatggggaaaaagacgggaaaaaagatgctcctgtagtcccagctacttgggaggttgaggcaggagaatggcgtgaacccgggaggtggagcttgcagtgagcctagattgtgccactgcactccagcctgggcgacagagtgagactccgtctcaaaaaaacagaaaaacaaaacaaacaaacaaacaaacaaaaaaacatataattctgcagaatgcacatcatttttattgtctcaagaagaacttaatagcaattagccaaacactagtcataatgtatattcataaaattcaaaggactgaaatcatacagaatgtttcttgaccacaatttagttgagctagaggtcgatagcaaaaacgagccaaaataagaaaaaataaaattaaaactgaaaaatgctcatgtatatacagaaatcatttccaggtggattgcagatctgaatatgaggttgtaaaccaaaaggtatttgagacaggtctcaatcaatttagaaagtttattttgccaaggttaaggacatggcccctgacagagcctcaggaggtcctgaagacatgtgcccaaggtggtcagggttcaagtgtgcttttatacattttagggagacatgagacatcaattaatatgtgtaacattgccttaggtacagtaaatcaggactacttgaggggggcggaggcaaaagactgtattcttttgagtccttgatcagccttccactgaatacaccaatacacaatttggtctggctcagtgaatctacatttttacataaacaatgcagtggagaaagcaatcagacatgcatttgtctcaggtgagcctcagagggatgactttgagttccgtctgtcctttgtccacaaggaaattccctgtgggggaggtatgtagctttttatctttgtagctaccttatttaggaatacaatggaaggcaggtttgggtgacatagttcccagcttgaattttcccttggcttagtaatttgggggtcctgaggtttatttttttttttttcacaaaagtaaacaatgcatgttttacaaagaaaacataacaaaacatcttattgctcttagagtaggcagtaattttgcttatttaaaaaggtatagcctgggtgcggtagctcacgcctgtaatcccagcactttgggaggcccaggcgggcagatcacgaggtcaggagtttgaggccagcctggccaatgtggtgaaatgccgtctctactacaaatacaaaaaccagccaggcatggtggtgtgcgcctgtagtcccagttactcaggaagctgaggcagaagaatcacttgaacccaggaggcggaggttggagtgagtcgacatcatgccactgcactccagccaagtaagactccgtctcgaaaaaaaaaaaagtataaatcagagaagaaaaaataataaatcagactattttaaaatgtagaactactgtttatcaaaaatatgccatcaagagagtaaaaatgctgccaataaagtgggaaaatatccaattacttagatcaagagcacgtaagaaatgatgcttaacatccttagtcactgtggaaatgtaaattaaagccactatgccagaatggctaaactgaatactcttcagaaatgagaataaacaatgtacagttacaagtaaaaatatggattaatttcatgaacgtaactgagcaaaagaagttacattaaaaagtatacatattctatgattaaattgcataaagtataaaattaagtgaacctaatctatggttttggaggtcaagatagagattaattctccttcccatagggtgtggcatgttgacaagataaagtattgagccatacacaataaaccatactatttgtttgtttaattttgagatagggtcttgctgtctttcccaggctgcagtgcaatggcataatcatggctcactgcaggaccaacctcctaggctccagtgatcctccacttcagcctcctctctgcaactacaggtatgcaccaccacacctgatgaatttcttgtctttcatagagacaaggtctccctatgttgcccagggtggccttgaactctggggtcaagtgatcctttcaccttagcctctcaaagtgttgggattagtcataagccacagtatttggccttttaaaaatacatacatatatattgaaaatcacttttttttctttccaactttttttaggttcgaggggtacatatacaggtttgttacatgggtaaattgcatgttgcaggggtttcttacacagattatttcatcacccaggtaataaacacagtacctgagaggtggtttttcacacctcactctccttcaaccctccaccctcaagtaggccctagtgtccattatttataaccatgtatactcaatatttagctcccacttataagtgagaacatgtggtgtttggttttcttttcttgcattaactaatttaggataatggcctccaattccacatgtgttgctgcaaaggacatgacttcgttcttttttatgactgcgtaatattccatggtacatgtctaccacatttcctttatccagttcagcactgatgagtgtctaccttgattccacatctttgctattgtgctttaataaacatatgcattaatgtgtctttctggcagaacagttatattcttttttcttttttttttttttttgagacagagtctcgctctgtcgcccatgctggagtgcagtggcatgatcttggctcgctgcaagctccgcctcccaggttcgtgccattctcctgcctcagcctcccgagtagctggaattacaggcgcccgccaccacgcctggctgattttttgtatttttaatagaggcgggtttcaccatgttagccaagatggtctcgatctcctgaccttgtgatccgcccgcctcagcctcccaaagtactgggattacaggtgtgagccactgcacccggccagaacatttgtatcttttagatatatacccagaaatggaattcctgggatgaccgataattccattttaagttctttgagaaatctccaaactgctttcctcaggggctgaactaatttacattcctgctagcagtgtataagcattccattttctccttaatctcatcagcatcaactttttaataagctattctaactggtatgagatagtatctcattgtggttctgatttgcctttctctaatgattagtgatgttgagcattttttcatatgcttgttggctgagtgtatatcttttcttgagaaacgcctattcatatcctttgcccatttttttaatagggttattttggttttgtttgtttgtttaagttccttatagattctggatattagacctctgtcagatgcatagtttgcaaatattttttctttcaatttaggtttctttcaatttactctgtggatagcttcttctgctgtgtataaattctttaattagatcctacttgtccatttttgttttttttttttcaattttggaatctttgtcatgaaatctttgacaggacctatgtccagaatgtttattcctaggtgttattctagggttttatagttaaaagttttacatttaagtctttagccctcaagatgagttacattttacatttttcatttaactcattaagtctttaacccatcctgacttttgtttatagtaaagagaaggggtccagcttcaatcctctgcatatggctagccagttacccagcaccattcattaaatagggagtccatttaccattgcttgtttttgttaactttgtcaaaagttgtttgttgtaggtgtgtgaccttattcctgggttctctatcctgttgcattggtctatgtgtctgtttttatacttgtaccatgctgctttggttactgttgccttgtagtagagtgtgatgcctctggcttagttctttttgcttaggattgttttggctattcagactatattttggttccctataaattttggaatatatttttctaattctgtggaaaatgtttttgatagtttgataggaacagcattgtatctataaattgctttgggcagtatgaccatttgaacaatattgattcttcctacagatgaccatggattatttttccatgtttgcttaatctctgattactttcaatagtgtttcataattcttattgtagagatctttcccttctctggttagctgtcttcctaggtatttttgtatgtgtgtggctattgtggatgggattgtgttttaatttgcctctcagcttggatgttgttggtaaattgtgtttatttcgatcttcagttttctttattactccaacttgtggtctatcaatcttattctttcaaagaacccactttttgtttcgttaatctattgtatttattttaatctcaatttcattcagttcagctcggattttagtatttcttttcttctgctagttttccggttgatttgctgtaagttgggttcagctgagtggctttgtttctggatgatttcacggggggccaggctcagctgagcactcttgagctgcatgctctatccataaggtgtggtgtccaggcccataacttcgttctctgtccccgtgaggttaagcagctgctgtgctggaggtgctagagatgttcccagtccacaagcaccagtactctgataaggggtgctggaaaaagcacttcatcaggatagtggcatcagggtccacacatgcacacacactgacaacagtgtgatggcagtgtgatggagtctgtgtacacatgctcatgctagtgatggtggagtggctgggtctccatgcacataggcaccagcaggggctgggttatggtggtgagttccacatgcatgcatctgtggtactgggtgatatgttttggctgtgtccccacccaaatctcatattgaattataatccccactggttgggggagggacctcatgggaggtgattagatcatgggagtggttcccccatgctgttcttgtgatagtgagtgagttctcatgagatctgatggttttataagaggcttcccccttccctctgcactcattctctcttctgccaccatgtgaagaaagatatgtttgcttcttcttccatcatgattgtaagtttcctgaggcctccccagccattcaaaactgtgagtcaactaaacctcttttctttataatttacccagtctcaggtatgtccttatagtagcgtgagaatgaacgaatagactggggttgtgagaggttcacagagtgcacaccatagcatagtagtaggaagaggccataggcaggtgcttgggggcaaagcagtggtaggaggctgctggcaggtgcatgtcatccgggcctgtctgctaaagctctccgatggttaggtagagtccacaccaagtagctatggtggcagctgctgcaaaatgcctctgttggggatctcaggctgcagtgcaaatgggtgtggccggggaggtgccccagagaaggaccagcaaacaggggtgtgttcagatcagactggccccgtcccatggaccagatagctctgctctgttcaggtctgatagtcaacaaaggccaaagccacctaggggagtgtggtaagccttggaggatgtgcatccctggctatgctctactgtagtcatgctgtgccaacaccccccagttcccagccccaaaggctgacacttctccaagcagctctccatgccagctcggatgtatatggaggtcacggggattcctacggttaatactctagaggtccatggtaagtccatgggccacttctcacctatttaactcactccttccaaggagtcactgggggctgggaacaagtcctggtgcttggcagtctcatgcagggttcccagcttcctcccccttcagcccagtgtctgcatgctccctttttccactcttaatgatttccttctaaagatctccttagagtatactggacttcatgatggtctgttttcaccatgggagatgcttttccttgctgtttctagctagccatcttggctcctctcgcttttttgcatgtgtatttttatgtatatgtcttctacagagaaagcaccaaatttagatgacttcactgataagtcctaccaaatattcaagaaagaaatcctaaactaataaatcctaccaaatattcaagagaactattatataaaacctcctagagaatagaaaaacttagaaatattttcaatttattttataagagcagcataaacataatgctaaaagcaaacaagtatattatgtggaaagaaagtattaataggctgggcatggtggctcacacctgtaatcccagcactttgggaggcaaaggggggggagcacaaggtcaggagatcaagaccatcctggccaacatggtgaaacccagtctctactaaaaaatacaaaaaattagctgggcgttgtggctggcgcctgtagtcccagctactcaggaggctgaggcaggagaatggcgtgaacccggtaggcagagcttgcagtgagccgagattgcaccactacactccagcctaggcgacagagcgcaactctgtctcaaaaaaaaaaaaaaaaagaaaaaaagaattagtaataagttaatttcatttatatacagagatgcagctgtcttaaatcattagtgcacaaatccagcaatacataaaaagtacagtattatcacaaccatgcaagatctattccagaagtggaaggttggcttaataatgaaaaatcaattaatgtaatttacttttatattaaagcagaaaaaatcatgtacagaaaaggctattgataataaaaatcaaaagctagtgataaaatgcaataatcatttatggtacagtatttagcaaagtaggaatagatgaaatttttctttttttttttattatactttaagttttagggtacatgcgcacattgtgcaggttagttacatatgtatacatgtgccatgctggtgcaaaaatttttcttatctaatagaaggattttgcaaaaacttgtagcaaatgttattatgaattgttaaaatattatccaatgagattagaaattagaaaaaaagttcctaatattatttccctttcaaattatactgtacattcttgtcaaaacaggaaggcaagaggaaaaaagttataaggttgaaagaaagcaataaaatgctcattagctgcaaaatacatgattatgtatctataatatccaatgaatgtacagatgagttatctggattattaagaagtttagcaaggatgttggtgcaaggtaatacatcaaaactttatgtataaaccagtggtaaacaattgaaagtaaaatttaaaacataatattataatattattgatatatcatatatcaaaaaatagtcctgcaagaatcttaacagaggaaactgtaaatcattattgagaaatcttttatacatgttcatagttaaggaagagttaaataaagagaagagaatatatgttcatgaataggaagactcaatattttaagatgtaaattctcctcaaattgagctatatgttcactggctaaatcccagtcaaaatcccagcaggtatttttagatatcagtaagcagacttttaagttatcctgcttttatttcagaatatggccaagaaaactgagggaaaaattttcacttcacacaactgagccaagttacaggatatttccatgactggatcttccaagttccagaacagaaatattaagctgcaattgtaagatctggttctagatgagtggctattaatgctggttgaagaatctgcaaaactgctacaaagggaagaatgagcccactatgcacattgggatgggaaactattaaaaaaaaaacaaaaaacaaacaacaacaacaacaacaaaaaactcctccaaaattagaaaaccaaaattcccatttccctgaagaaatgtaatgttgatcttttggcaagtgtgtcaagttctgtgttgcaaacaaacaagctccaccttatttttatgaaaaggctacccagttacccactttgtcactactcttagattcaaggttcatgatgtggtttggatttgtgtccctgcccaaatctcatgtttaattataatctcccatgttgaaggaggggcctgctaggagctgattgaaccctggggccgaattttcccccttgctgttcttgtgatagtgcatgagatgggaagacagtatctgagtgtttaaaaatgtatagcaccttcccctttgctctcttcctcctgctcctgtcatgtaagacatgcctgctttcacttcacccctccatcgtgattgtaattttcctgaggcctccccagccacgctccttgtatagcctgcagaactgcaagccaatcaaaccccttttctttataaattacccagtttcaggtagttctttatagcattgtgagaatggactaatacagttcaggatttgcaatttaaggaaacatgcggtgcattctatcatattctctattattagtagatcttttataatacggtacatttcaaatgtgttcctccccaaccacaaagccatttatttatctaaacggccttgccatgtcaaaggcaaggctactgttcagtaaacccctctaaatcagaatgtcattagaagaaatttaaattatatgtaaaggaataaaagctgaaaattgaaggcttttgttttgaaaagttgaacttacaaatttgcaagtgtcattttctgtatttccgaaatactgtaaaatttatttatcataaagtttaatattagaaataaaagcttattactaaaaaaagtaatgttaagaaagacaaataatatagcaaacactcaaaattgtaatttcactcatataaattcattttctacaataatcagaggaaaattaaaattacatgttcaaaatttggaggtgaaagcagggatcaactgtctattaaagttactaaatttgtcataaaaaatttaaagactctggaagatttggtttcatttaatgagttcagggaattaaaaaaacatgtttttctgtatttttttgcaagttcttgtcagaaagcatttggaaaggcaaaaatatatagcagagagatcaaatacggttggagttgagattcagaggcagagataagtgatatggttggagtatatcaatctcccaaggagccacttcccaggttcggaatgtagaaaccaagccagaagtaagagtggcataaaatcatctccctaccacctgcaaactacctctcccatctatctaaacagtggaaatttctggtaatttaacaaaaagtatttatgagttgttaacaaagatatgaaaagctaaaccattgtttcaggtaccatgcaaattgacaatgaagtgttgaaaatgaaacatagggcctcttttccgaatattattatgtattagtccattctcacactgctacaaagatactacctgagacttggtaatttataaacaaaagaggttaaattgacttacagttctgcatggctggagaggcctcaggaaacttacaatcatggcagaaggtgaaggggaagcaggcacctttttcacaaggcagcaggagagacagaaagagcgtgagcggaggggaagtgcccactttcaaaccatcagatctcatgagaactcactcactatcaggagaacagcatgggggaaaatcccctcaataatccaattacctcccaccaggtccctccctcaacatgtggggattacaattcaagataagatttggttggagacacagagccaaatggtatcatatgatctaattgttagacagaatcataaatacacaaagcataggtgaaaagtctcataatagcattaacaccataaaattatgaaagaaggaggagcccattcttcaaggaatgtcaggaacagtttcagaaaagaatctttgagctaggtcttgacagatgacaaatacatagtctcatatggttaactcttgagccttatgaggatgaaaaaccagtatcagaaataaagaccaagttttgatttatcttatgtgccatgttaagtactttaggctgaaggcagtaggaataaatcagctgatttttaaacaggagagagagatacgggcaggttacttatatcggaatcagtgggtgggatagattggataaaaggggcggggaggagaagaaggggcagagaagggaagggagaggagaggataaaccatagttttattatctaacaaaaagcttccagggaatttaggcagacgatagtttttcttaaggctcctttttttcattgactcctttctaattcccccaagtctcaattctgttttctcatttttaatttctatatctcatgtgaacttacatctgcattgatatgattttcattagatattataaagaagaatatttataattaatctaatgttaggaatatttagcatgcaacaagtgaatataggtgcttactaattaatgccttggattacagtgtcctaatgcctggaggtttttggaagtaactctgatctcagtaacacttaccctattgctgtttatctaacaaaacaggcattgcctcagctcacagcatttgtacttgctgttccctttccctgggatgtactttcctcaaacatctacagggcatattcatgtatgatctctgaaatcaccttgcttctgactgcagtatataacatagcaaaggccgctgctcaatttcccaccacctccaattctgtttttccaattctgctccccttttttccacagtatttattgccatctgacattctatggatttgcttgtttgcggccagcctcccccacgagaaaggaagctcctcaagagcaagaattttgttttgttcactgttgtatgtccccggcaccaacaacagtgtctggcacagtgtagatgcctaggtgatatttgttgaatgaattagtaaataatattcctataaaatgtggtgaaaagaattccacatgaggaaattaaagtctagagaaatacaacaacttgctgaatataacttaacattagcaattattatcactgtcattttagtactatttttacaaacctatgctttgacatataaattagctccagtcatcacagcagcgctgtaagatagatgttgcagacagttgtatagattgttcaaggtcagctagctaatggatagaagaataattttctgaccaaatggtgatttgttatatttggatggaatctatgtttcctagcaatttacctgctgggttgcacttcatctgccttatatcccttagctttcttccaccttctgcttacatattgaagaattacaggcttatcattatatatttgcctactgattaaatgtattgtaatcctttatggaattaccataagagatactatggataggctagaacaaactttgaaagagaggtggtgtattcgtttcctagagctgctgtgttagggttcttcagggagatagaactgataggatatatatatatatatatatatatatatatatatatgtatgatatatgtgtatgtgtgtgtgtatgtatatatatatatatatatatatagagagagagagagagagagagagagagagagagacgagatgagatgggaattttttaggggaattagctcccatgacaggctttctgcaacctgaaaacactgaaatgctgatagcatcgcttagtccaactctgaaaacctcagaacaaggtaaacaaatggtgtaactcaatctgaggctaaaggcctgagaactcagggagttgctggtgtaagttctggagtccaaaggccagagagcttagagttctgatgtccaaaggcaggagaagaagggtgtcccagctccagaagagagagagaaagaaggagagcaaatttgcctttcttctcgctttttgttctacctgggtccacagccatttggatgttaaccacacacattgagggcagatctttccccattcagtcaaccaactcacaattcatgaaccaatctcctcagaaacaccctcacagacatacctcatggaaataatgctttatcagttctctaagtactccttaatccagtcaagttgacatctaaaattaaccatcacaattgctgtcacaaaataccacaaaactacagacataaaactcacgtaaaactacagaatttttgtttgtttcacagttctgggggctaaaaaatcaaaggtgccagaatcaaaggcccaaaatcaagatattgggagggccatgctccctgtgaaacctgtaggagaaaatcttccttgtctcttcctagcttctgacggaggtcattgatccttggcattccttgggttacaaatgcatcgctccaatctctgtctctgtcatcacatggcattctccctgtgtgtttttatcttcatgtgttcatcttttatgtacgtgtgtgtgtgtgtctgtgtccaaatttctcttttcttatgaagacaacagtcatactggatttgagcaatccctaactgacctcatcttaactcgattatacctgcaaagacccaacttccaaatgaggtcgcattcatagatgccagggtataggacttcaacatatatttctgcaggacacaatgcaacccatagcagatggagagcatcagcatgatgggattgctaataatgggtttaacgtatcaagctttttctcaattcagagacttctcatgtattgtctcctctgtctgcattacttttctgcccactctttgctcaagttctggtgttgtactggagccatctcacaccagctcctgagggtcaattgttaaattatcagaagccagttgccaaacacagcaattattaaaaattaaatatataaacataattaattacatttaaagcaatggtaatacattctaaaaactcatccatttctagctattttgctacatttgattattatctatctatactctttagattatttgcatctattatatttacatagcagaaatataaaatacttgtattcatatgtctccctaaatacatattcagtgacctcaccttggtagtttgaaattggccacagagtggatatatttataatacagaaatcagctaccagtacaaatcaggtctttttttatccttggaaaagcagctgttaaatatttaccagatatactggttaattctcgtacttcctttaggcctcatcttcatctcctcagaccagctttccatagcatccatttaaaatagactccttcctctcattattctctttctgaattcctttttctattcttcttgaaactcttttttgtaattgtgcagttatacatgcatttattgaatatctgtttttctcactaaattaagtttcttgagagcaggacccatgatttttttatttctgcttatttctagcacagaaatacagcatttagcatatgacaggcacttaataaatatttgttaaatatttatgatgcatttgaggatcaaatggaaaatcaaaattatgagatagtatgttaagtttggtgatcaggcaaagttaaagcatggccaaaaggcactgagtttccagttacctgctaagatgtgtaattaaatttaggtgaaaattgagagtgttaattccttggtatctatttttcctgcctctttgcacttatgatttgtgatggtaaacattaataatcagatgcatgggacaactgaagtaaagagagatgtgtatggcgtatacccagtgagaggttcctagaatgtagtaaatttattctaataaaagaatctgacaattgaagaaaggaatgcaaactggcctatggcatagttaccgacttaccatttgtgccaacgaatccttgggtgacctcactgtaaggagctacatgagataaagatgggctcaatgtagaaatgaaaataataaatgccttcaatgggaggataggtcaacatatttgaagtattctggggtactactaagcctgggaaataatctagggacagaagaggtgggcactagtcttggcttccaggctttaattaaacacctatatatgggcagcatcagctgtagttaggaagcagttcattccatccagagacttggttaccgaaggcccagacttatcaagcatggccaaatggtaagagtaagagtcttgaaagtagacatactgagatattaaaattaactcttagtttattaaatgactttcagtaatgtaattaatctttctgcagttggtttctttatgtcttaaattggggtaacagtacaaacatgttggagaaaggagaccaccactaaagtttaaggaagttttgcatgaattagtaaagggcatcgactctgagctaatgcagtccctctagctaatggcttggcaagaaaatgactcttttgcataagtaaaaagatagtttcttgtttctggtgctcatactcagggtacaagactactggcctccaaatgcaggaagcaagagatctgtacaatcattctgggtcctggggctgaggtaaagattaaacaagatcttatattaaaacactgagctgtatttgaaaacttaaccctgtcacaaatgtcagtttccttcccaaaaatctctcctccttttcttctctttcctgtctccctgacaccactatcaagttggatttccttgcccttggagacaagttagttcaactttaattttctacaagtatctttgtttcagaccctgaatagataacagagagtcatttaccctgttctcattgctctaccccatgtaacccccatcccatgtaattaatcgtaaagtatattttgttttatgaggtatcctgagtaagtgctaatggagactaagtttagggagcatgaaatactgctacctttctccatgtgccaataaacctgctcagtctcagctgtaaaaaaacaaacaagtaaaacctgtttttctcttgttccttaaattatgtcagtacctggcagttgtttatgtttaaaaagtcaacagaaggcagtcaagggaccaggaacatgataagtgtttaaagggtgtgatttactactcagcagtgtgccagtgatgtggcatgaattaaaaacaagaagtcttccaggagaaaagatttctttagagatgtaattaattgacctggcttgggtccctcctttcccggaggaaaaacttctccttttccggagtagttgtcagtgaagtgtttcaaatactgccctggttgtaattattgttcaagttcatgctgcaaaatcatcttcacttaataattctagcattcaccacccaaaaactcataagcaaggcttttgtattgccacacagtttgggattttttttctcagaattaggaagcaaatgtagccagcaattattttagatattgctttcagaaatgaatttttcccatatctgtcagatttggctcagagttctttttcaatttaatcattgttagcagcatgaaaaactgttaagttaaatgttcaggcataagcaagtcattactccatatttgaactctagagagctactggttgtcatggtaatatgactgcacgtgtgaagttagcattggcaacatcacattttcattaaaacatcatgcatatttgcatgaacttctgcccagaccattgttgcaggattggctcctccaccccatctcataatggtgccaagagatttcatatttcagatccaaacttgttagagtttacagcattcattattcatccctcagagatagaagttgacctgtattcaaggcttaacatatatgaatagagagctcactatatatctctatggttaatcctactaattaccgttcccctgaattgaggtaaccctcccatttcttttagtgaatagttttaattactttctttgacttgcctcttcccaaattagggtatgtttcttcaaataactccccatggatttgtagtgttgctattactcctgaagatgtaggtttccccctcccctcccctcccttcccctcccttccccttgatggagtttcaccctttcacccaggctggaatgaagtggtgtgatctcagttcactgcaatctctgcctcccaggttcaagccattctcctgcctaagcctcctgagtagctgagattacaggcacatgccaccatgcccagctaatttttgtatttttagtagagatgaggtttcgccatgttggccaggctggtctcgaactcctgagttcaggtaatccactcgccttgtgctagaattttttttctccttatgccttcttcccagaacctctattatgtttcctttggtttagggctgtgattatacttatttgcccatatgatcatttatttattcaattaataaatatttattatggtttactatgttgtagggtagatgttagatcccaagtaagccagggcaacaattagttgattagagatgtaagctcttgctgtctaccctgttcttggccaaattgtctgtatttcaatgcagcagatatcttcacaaaggtttttttagcacacaaactgtttgttaagtcctataaattagcaaacaatgctagtttactttttgtttccatgtcattgtttaaacattcttttgttgagctaaaggtttgaatgaataaaccaacaatgaggaagtgccagaacagttcctgtatataccctgcatatatttatttgcagattttactagctattaaatatcatataatacatatcggctctctcctttctctgcttacacatacatggttcctgattgatcaataatttaagtgttgcatttggagattactataggagtttcaaatggtgtccatggtacttctgtttgtgcctctgttcatattgctccttacacttagcctgcctttcccgtcccaaattcccactgaagacctggagaaggcctcatctttcaaaattcaattcaagtatcatttcgtttatgaagtgttatataacaataagaggataaattaataacaggataaataaagaataagaaagcacactaaaaactcttttttttttgaaacaaattcttactctgttgtccaggtagagtgtagtggtgcaatcatggttcattgcagcctcaacatcccgggttcaagtgatcttcctgctttggcctgccaataactgagactataggtgttcactaccacacctgtctaatttttgtgtgtgtgtgtggagatgaggtcttgccatgttgcctaggctggtcctcaaattcctaggctcaagcaatcctcctgccttggccttccaaagtgttaggatttacaatccagagtcactgctcccagactaaaagcatttttttttttaacaactctggaagtgaattccagcagaaccagcaaaaagaatggaattaattacctctggggaaagtgcctaagggtaaggagaactggggcaggaaactattataagtcttgtaccactattaagcttctaaaatcatgtacatgccattttaatttttaaaaagataaatttttaaaactctatatgcttacattaaaagtatactagttattctgtagtatttctcatcaaattattttaatttggatttttttttcactaaatttaaatggacagcagacccagatgaataataaagcataaagtttgatttcagtaaattgataacttgataactttgatcatttgtgtatttatgccttctaattacagccctctaaaaatacatcagattggtttttaaaaatgtaatctgtaaaagcctttctaccgattgctaactaaatgtcaacatctaccatgtactcttaggaatcattaagaatacaactgagggtcatagatttagaaagatatttaatccaccctaaagatgagataccgaattaggtaatatctagaagtctcttgcatgcctccttccaagatatttataactatacctgaatatctatttagatacagatatctaaaattctggggattgttggatctaggcaagttgcttttaaatgaattatgtgaaaataaaagatctcagaatatctgggaatcttcagtaagagaagaataatgagaaagaatagcattctaaaatattaaagcatattatgcagctgaaatttaaaaaatattattggtttatcaatgaatttgatagagctaggatggaatataaaactcaaaaatacatatgtgaaggtagtttatgataaatgtggaatttcagatcatggtgaaaagaatttttcaatagtggtaggaccacagttttacagccatttagaaaaataaataaaatgcaattttaaaacgctagatccatgttttatgaaaataagagattcccctcccccccttttattttgagcatttactttagaaaacttgtaattatacatacttgatactatttctgaaaaaaaaaatacatccttttgaaacctaggaaagacttttttcagcttaatcatccaggaatatctttctcaaggacctggaagctgtctctttgaaatgtaaacatcaaaggagttagtaccctgcctgccagtttccgtgagcggataggagtctaacttgggtaggcacttccctccaagtggcaaaactacctcttgtcattaaaaaaaaaaaaaaaagatgtttgtttctcttctaagtaaagccaattccagttagctaaaataaatggtcaccccagttatctggtaaagataaaatggtgctgtcaagccctcttactcgaagactagttattatttatcttgataatatgtgtgtaatgggctgtatctgcttggctatataaaatttctttctgtctttgcaatctctttgtggattgcctgtgatatgctcacattctagattaattcttattcaataatgaatttttttttgtctctctactacttttataggaaagatttctagattgagagattattttatcaccaatattgctaatgcagatttcctctgctgtaaatagcctttgtattagtttgttttcacactgctataaagaatacctgaaactgggtaatttataaagaaaagaggtttaattgactcacagttccacatggctgggaaggcctcaggaaacttacgataatagcagaaggggaagcaagacagcaggagagagagtgaggcaggggaaactgccagaaacttatcaaacaaccagatcctgtgagaaatcactcaccatcatgagaatggcatggggaaactgtccccacgatccaatcacctcccaccaggacaacccctaccctgcccttgacatgtagggattacaatttggattacagctggagatgagatttgggtggggacacagccaaaccatatcagccctgtttttatattggttctcttgtctgtgttggaattctgactaggaccctgtgtggggtaaaacactgtgggatagagatggggcaggttaactagcctggttttctctggggtgagtggcaggaggtatctttcagctgggattaaaaccaagcacattgcttcaagaatttcttactgcttgacttgaatgaaaatgttattactgatgataattttggggcataatctcatgcctaactggtattggaataatagtaagatgtgtaataaacacatgtgagtcttgagaattccgctctgattttgactcacagtaagttacttgataaagtttgtcctacagtctcactacttctcagcaaaattcttactgtgtgatcagatactaaatttctttcagtttattcccagtaaatctgatggaatgtctagattctgcagactttgatccaaagactgaactaaatccaatgaactcaagagaacaacttttaagtagttattaagctgatattctgtgttcagacctgtgcctgggactgaaagaacataaataaatgtaactgaggaagtgttctttctctttgatctagatggtaacttacctaggggacaaatgggagtgggcagatctgaagaaaggaagaatctgttgtaatagtctaaatgtgaggcaatgaattataaggtttccataatagagatgaaaagagacagaaagataaactaccaaaagaattaaaggagcttgataagttcctctgaaaaggctaaattaaaatgagacgtaaatgatcaatgattgacacaagatagtacagcagataaaaatatggatttcggtgtctatgagaactgaattcaagtcccagatctgacattggaattcaacagttacatgattcttctcagtttcagtttccttttgtgtaaaatataacaaacagtacttccttcagaaatgtattataaagttagtgtttttaaaactacaggttatgcctttttcttgagaaattaactttacagtttaatgaggaacagataacattttaataagaaagatctggaaaagaaaagtagaatgcgttactcatggtaaaaataagtatttttgtaacacttttttatagtgattgtatatatgtgtgtgagtgtgtgtgtgtaagagaatcattggattaaaaattaaaataaaaataatagctatttatgacaaatccacagccaatatcatactgaatgggcaaaagctggaagcattccttttgaaaatcatcacaagacaaggatgccctctcttaccacttctattcaacatagtattgaaagttctggccagggcaatcaggcaagagaaaaaaaaatggtattcaaacaggaagagaggaaatcaaattgtctctgtttgcagatgacatgattgtatatttagaaaaccccatcatctcagccccaaaactccttaagctgataagcaacttcagcaaagtctcaggacacaaatcaatgtgcaaaaatcacaagcattcttatacaccaatgatagagagccaaatcatgtgtgaactcccattcacaattgctacaaagagaacaaaatacctaggaatccaacctacaagggatgtgaaggacctcttcaaggagaactacaaaccactgctcaaggaaataagagaggacacaaacaaatggaaaaacatttcatgctcatggataggaagaatcagtactgtgaaaatggccatactgcccaaagtaatttatagattcaatgctatccccatcaagctaccattgactttcttcacagaatgagaaaaaaactactttaaatttcatatggaatcaaaaaagagcccatatagccaagacaatcctaagcaaaaagaatgaagttggaggcatcacgctacctgtcttcaaactatactacaaggctataactaaactatactacaagtcaccaaaacagaatggtatgggtaccaaaacaaatatatagaccaatggaacagaaaggaggcctcagaaataacaccacacatctacaaccatctgatctttgacaaacctgacaccaacaagcaatggggaaaggattccctatttaataaatgactttgggaaaactggctagccatatgcagaaaactgaaactggagcccttctttataccttatacaaaaattaactcaagatggattaaatacataaacataagacctaaaaccataaaacctgtagaagagaacctaggcaataccatgggcatgggcaaagtcttcatgactaaaacaccaaaagcaatggcaacaaaagccaaaactgacaaatgggatctaattaaactaaagagcttctgcacagcaaaagaaactatcatcagagtgaacaggcaacccacagattgggagaaaaattttgcaatctctccatctgacaaagggttaatatacacagtctacaaagaacttaaacaaatttacaagaaaaaaacaaccccatcaaaaagtgagtgaaggatatgaacacacacttctcaaaagaagacatttatgtggccaagaaacatatgaaaaaaagctcatcatcactggtaattagggaagtgcacatcaaaaccacaatgagataggatctcatgccagttagaataggtaccattatggcttacacctgtaatcccagcattatgggaagccagggttggcagatcacctgaggtcaggagttcaagaccaacctggccaacatggtgaaaacccatctctaataaaaatacataaattagctggacgtggtggctggtgcctgtaatcccagctactcgagaggctgaggcaggagaattgcttgaacccaggaggcagaggttgcagtgagccaagatcatgccactgcactacagcctgggcaacagagcaagactctgtctcaaaaaaaaaaaagactagctatcattaaaaaatcaggaaacaaccgatactggcgaggctgtggagaaatagggacacttttacactgttggtgggagtgtaaattagttccagcattgtgaaagatggtgtggcgattcctcaaggatctagaaaaagaaatatcatttgacccagcaatcccattaccgggcatatacccaaaggattataaatcattctactaaaaagacacatacacacatatgtttattgcagcactattcacaacagcaaagacttggaatgaatccaaatgcccatcaatgatagactggataaagaaaatgtggcacatatacaccatggaatactatgcagccgtaaaaaagaatgagttcatgagttcatgtcttttgcaggggcatggatgaagctggaaaccatcagtctctgcaaactaacccaggaacagaaaaccaaacactgcatgttctgactcataagtaggagttgaatagtgagaacacatagacacagggaggggaacatcacacactggggcctgtttggggatgtgggaaaaggggagggatagtattaagagaaatacctactgtagatgacgggttgatgggtgcagcaaaccaccatggcacatgtatacctatgtaacaaacctgcatgccctgcacatgtatcccagaacataaagtataataaaaaaattaaaatgtacttattgttatggattgtctttaaacaagtttgaaaaagcagcactctataatacataaaaagtgttttatgtgatactaacacatttgaaggaaacaagacgtgtcacaaaaatcaagggaggagagcttcaaggatgggctgattaatgctgttaaatatagtagagaacaagggggataaaatctgagaaaaggttggttttaagaataattagcttatagaaaattaaacgtgaatttagtctgcaactattagtaataacacacagtgacattttttataatgctaaatgatagtaaataatctaaaaaatctagtgaaagaaagaaatatgcaagatgatttccacacaagaattacaataaataatgaaaagcagttctgggccttttggtttgctccctggaaggagataaaatagttaattaaagttttattgcttttgaaacattctccaatttaagaaaaggtttgagatttgttatatatggtgcttacatggaacacatgaaacctttatgagacttttttccctgtttgatagggaatgaaactttggttgaatttccagtgggatggggtgagtctggagataagctttatggtttctcctgctggtgtctccagatagcaaacacagcagcggcttccagtctgtggtgcaaagaaagaaatactattctctagtgcagataccatttcacctatctttttataaaataccagattttggtgaaggttcttaagatattcaaataattatctccaagtatctgctgggtggcatggcaggtgaaagcaaggagaattgagacaaatagatagacaggaagtcaaatatctcacttctttttaccccattagaggaaaggcctcactgtctaggcctcattttgagggtcccagtacaccttcctcattctccaagtttctgatcccttctccataccctgcagtctttagatctttttttgctatcaaatgtccacatgtctcagtcagtctagattactacaacaaagtatcattgacttagtgtgttgtaaatgatagaaatttatttctcacagttctggaagtggcagtcccatcaggctgccagcattgctggcttctggtgagggttctcattcagtttgcagatgaccaacttctcatgtatcctcatgtggtcgaagcagagctagttagcattctggtcttttcctataaagacactaattccattaatgagggctcaactcttattacctaattactttccaaagacacctcctcctaaatgccatcgcactgggagtagggcttccacatatgaattttaagaagacacaaacgttcagtccattgcactgtatgttttcattttctctagatcagtcacttttttcctacaaaatttatacatatttagtcttcctccatctcatctagtatctcctaaaattatcaattttaattaaatttccaaggtttttcttttttctttttagttactgttgctctgcagaagagtggccatgtctctttgttcataactcctgtcatgtggggatagaatgtggtgagagggtccataaattattgggtctatgcataaagtgctctagggaaatactggggttctattgctgcatgatatagctatacgttcccagcgctgattctcaaccacagctatactttagaattacctgaaaagctttaaacaatacctatccttaaactcttctcaattaaagtagagcctctgagtttggatcctgaaaatcgtgtgtgttgtgtttatgagctgctcaattgattctactgtgtggccaagtttggcaaccactgtcccagacagtatttcttctcaatctttaatgttgtattaatcacttgaatatcatgttaaaatgcagattaaattcagtagatttagggtgagacatgaaattgtgatttctaataagcctctatgagaagtagatattgtagtttcagggactacactttgaagagcaaggtcctagaatatttaaaattaattatatctcaccagtttattgtcttctgaaatatgctctttcctactcaagcttcaagaaggagaaattattattccatgagtatattctagttttagatgctgacaaagagcatcttgccatgtccgaaaatttactgtacctcattaatctttgcttactgttgtttatcaagtaactgattcaattaactaaattaatggtatcaattgtccccccccatgtgattctatggcaatatatagggcatgagggactctgtatgttaattctacaagtaatttggtatagtcagtagtaggggtcatttggggaaaggatgagaggaaaggctgcagagagaaggacaagttcattaaatgacaataatgttgaacattcattgcacacttactgtttttcagacactttgttatgtgctttatatacattatttaatttaatccccacaccaagtctacaagaagaaaatacttattaaaatgacaaatgagcttagaaactgctatggtttgaacgtttcctccaaagtttgtgtgttggaaacaattcattatgcaactatgttgagagttgagaccttgaataggtgattagttcatgaggtctctgcccttgtaattgggtgaatgctgttatcatgggagtgggttagttggcacaggagtgggttccttacaaaaaaattacttccgcctctttcctctctcatgtgcatgctttgttgcctttctgccttctgccatgagatgttgcagcaagaagaccctcaccaggtgccagcgtctagacattggattttccagcctccagaactgtgagaaattatttttttctttataaactacccagtgcgtggtattatgttatagcaatgcaaaacagactaagacagaaaccataagaaactgaaaagtttatataaatggattcagatcacatagctaataagtggtaagagccaagcctctatctctctcctgagtcccagctcttatcctgcaacaagcttaaatgggaagtcaaagacagcttttaaacacaaaagaaagatgatccagcagcatgaaggatataggcagggtaagaatggaggcttagatcccacttaggattcctcctctaagaggctgaaatttcataagcttatcaatataatttaagaactggaaacatgtctttttttaattactatcaccaaacacagtgcctggaatatagtagttataaatagttattaagtgaataaatgattgctattataattatgcagaagagtaattttgagagcctgaactaaggcagtgacagtgggaacagtggttgaaatgaaataaagaactagttgaaaagaaattttcagtaggttaataactaatgttacttttaacagccacaatgcttaaaatgcagagaaatttttaaatatttttcaactcaatggactaactctaatatttaccacaggaagaccaaaaatgaagtaataggcgtacaggggctgatgggtgtgccataagtcatacaatgcaggcagactcattttccatatcagacaggtgctgtacagactaaggaatgtggggtcaaactccgaagtcagaggactgtcgtcaagtctctttttcagtagtaggtatatgacattggttaaatctgacactctgctttttcatcatgacaatggaataatgctgcaggaaagagagaaaataatgatggtgagagctttttttttttttttttaagcagtacttctgctatccaaatttgagtatttatccaactattttcagttcaggggctacaatgcctcaaccatatttacatttgaggtatctaaatgtaattctggtgatgtattgtcatctgtaaatttctctattgtgacattattaatacttacattgaaggttattaaaaacttactaaaggtgtatttgtaaaaccactgaaaatttacttatattttttgtgtattgtaagttttttacaatgatcatatattatttttataatctgcagaggttagaaatgttatttcgaaggatttttatttaggagtcatggccgagaaaaaggtttctaaattaaaaaccagaaaagtcatttttactgttttaacaggtagattgtcaagtttagactcataacacagtctttcaaaggtttctactggacagaaacagcctcattttcacaatcgtagtcaaagcagaaaaacatacacagaactaaatgcctagcatctgataagatgaccttttgctgaaaaatcatttggaacagcacttgttctgcagtaactgtcatggtaagtacagacagaaatgggacaaaaaatgaaagctattttggtttccttctattcaacttacagaccacaacagcaagagcacaaattactagctaatctaaatataaaagttcatgagactttgctaaataagtatcctgttactcaaaggagactgagcatctggacttggttatggctgctaccgagttttttgtttgtttgtttgttgtttggtacattcagtaattgggtcgggtcataggatatatattttctttaagggcaaattttagggtgttataaaataatatgagttttaaaagtttaagggcaatgtggctttgaaataaggtacatgtgaattgaaaataagactgtaaattttttttgctgtatgacatacagcaaattactgagccactctcagcccagcatgaccttactacaaaattggaaaagttacacgtaactaaccgtgttgtaaagatgaagaaagactctaagattcatcttttctaaaacttcttaggtattcagtatacattgcttcagtgcaggaatccttaaaagatgtccatctagactatgttattattgtcagtatgttaagatacaatgctgcctataccacttttaaatgcctcttttacttcatgactttcaccttcttttgctaaagcactctgaatctctgagtcactcgccagtgttcagttctgcctttatttgatgctgcacttcagaagatgatttaattctattgtggagcaggataaaactaaataaaagtggtggtacctacctttacagagcttaaagtctaggagggaatgcaggcaataaataaacacgtaaaatgggaacagagattaggaaaatataacctaaactaaaaagctagaaatagcctcttggaggaaaaaaacatttaagcagagatttcaagaagaatggaataggcttagcagagtagaaacttaacaaatattggttgaaatgtattgagataaatcagaccaaatcattgcccatgcctgagcctgaaattttaccaacacagggtttaatattatgagtctacagtattagaaaaatggcttctattacttctattttttcagaataatatatttatatagttacaaaaaagagcacaggattacataaatgaaaaggaacaggttccccttttcttttcttccccacttttactccccagcaatatacttataagcatatctaattttatttctttcagtggtcacctcgactattaataaaatgtgtataattctatttcttgatctatcaaattcagacaatatctatttactttccacaatgatctatcaaattcagacaatatctatttactttccacaatgacaattgaggagttaatgttagttgacttacactatctgtcatcctcatacttttgctggttttgatgattctattagaactatacttcttatataaatttataatatactaaattttttgttgcatcaattttagacagcgtcctcgactccctattatgtaaaatgaagatatttgcatatttatcattctatcacttttcctcctcacaccctcctttaaaattgtcaggaatatatattgcttttttgttttgagggtagagaatacttacatttttctgtagctaaaatccagtcttctctaattcgtagccatgttaaatctgtaaatgaaaaactgataaatataatcaacatgttgtttattgaggaaccaattaatatgtagaacaataggggaaattgtaacatatatgtgattctatatcaccaaatcctttccatttgaacaacaacttctaactgtcaagattgatcacataaaatgtctttcttccatcttgtcaattcttgacaagcagattcactaatttgcttatttattttttctttaaaaatttttttatatagatttaggcagtacaagtgaagttttgttacatgggtatattgtgtagcggtgatgtctaggtttttagtgtagccgtcacccaaataatgtacattgctttcatcctatcacatagctttcctatcttatttatagtgttgaaattatggaatctattttctacatgatggcatttctaaagagctttaattttctacataagggcatttctgtagagctcctacttcagtgaaggtctgctcctccaacagaatttcaatatacttccctaccacaaagttagctgttagcattcttaaatcccctatcttccttgaattatttttcctattttgttggagtgcgtctcttgctatttttctcaggagtatgagagaagaaaaaattttcagtcttaaattgaaaatgcttttattttgcctcaacactttaattagaaacctgagttcctgcccccaggatgcgatgctcattgcatggagcaaggtgatgatgtccttgttccaggcagtgaagaaagggataaaaagggagagaacaaagaacaccactaaaagctgccctatgaaacatggactagttcttattctcatggccacatccagctttagggcatgctggggaacaggatttgtattccggacagaatctgcctggcttaatattttattactttgcaactaagaagaatgcatattggctcacaatcaacaaggtttgccatagccttaattaataaagcctaaaaaaaatcacataacttctaactttaaacagggtaaattctaagtaggttatagtaaattagttgagcagagtgccctgaggtatctgaatgattgaccagttatatagaactgttggctaaaagccagacaaatattagaagacatataatagatataatattttcgttttataattattttgaatcattcttagacaataattaggaagcagaatcaatcttcagttgtgcacaaactcaatgtattacaaaaacattgtgttttcagtaaaaagagaaatatttacccttcttttagtagatgaagagcaaccatgaggtgttaaacagtagtttggcccaagtgtggtggctcatgcctgtaatcccagccctctgggaggctgaggcaggaggattgcatgcatccaggagttagagaccagcctggaaaacatggtgagactctgtatctacaaaaaaaaaactacaaaaattagctgggtatggtggtgtgcacctctactccctgctacttgggaggctgaggtgggaggattgcttgaggctgcagtgagtcttgattgcactactgcattctagcctgggtgacatagtgagaacttatcttaataataaagaaataaatgaatagtataatttgaagactcttgctacagagatttttgtcttttatcaaatgacgtttacttattctttttctggtttagaaacatgcttttattttatagtgaaaacttctcaagaaattttttaaagtgcattttctgtacatttaataaaaatttgatattaaatgttcatttctgaataaagctaatgatgagtatatcacttataactaataaaatatttgtctgcattcagcatcaactatgctgaaaaccagaagatacatatcttctgaaaaaaaaatcagtatatggtttaaaagttatttgttaacttaaaaagaatctaatacctggtagtgtattgctgctataattaaaatctaaaacatatgttggcattgagacctggttgttggaagagactgaaaggactttgaggaagtagttggtaaaacttgaaggaaagtgagaaaaatattattggaggctggggaaaaaaactcttcttagggagtggtggaaatttcgacagcactgttgtctgagataaggtagaaaataggaaatgtacccactaagtcaaggatctagctatagacaattccaggcagaattttaaaagttttaactgcttcttctaactttctataataaaatataatatggagaaatgaactacagaagaataaactattagttttcaaagagaatttaagaggattttgagggcctaaggcagagtttccagtcaacaaaagtttctctaagtaaaacactgcctcggggtaaagatggagtaaacaactataaaacaccttggtaagtcctcagaaaaatgtaaagtactttgttgactcttcaagtaaaaggctgttattagtgtcttaagagtttaccttttggattctgtttgttaaacaatagaactcctcagaaaggacctcaggtagagagggatctatcttagaaagaaacatggtcttggtgggccaagctttcaattttttttttttttttttttttttttttttttttttttttttttttagacggagtcttgctctgtcgcccaggctggagtgcagtgtcgcgatctcggctcactgcaagctgcgcctcccgcgttcacaccattctcctgcctcagcctcccgagtagctgggactacaggtgcccgccaccatgcccggctaatttttttgtatttttagtagagacgggatttcaccgtgttagccaggatggtctggatctcctgacctcgtggtccacccatctcggtctcccaaagtactgggattacaggcgtgagccactgtgcccggccgaagctttcaaaatttttaaagaaattaggatcatggcacaaaaaggggcagcaagagttcaaaatgaaaaaaaaatggcttttgaacacctaatatatgagcaataaacatgctgaaaaactacttagctgtaagtacaggcaatttcttatagaaatggaagaatgactcggaggatgaaagaagtacccagctggcaaagctaagagacatgaagaatcattcccagggaacaaaaccatagcctaataaaagaactgataacatgtactagctaggtttcagaattgttctggactaagtatttctatatggcttctttttctcttttttgaataggagcatttactgtggatttcccatgattgtcttggcattttatgttgcatgtatgaggacacgggtattacgttcctttagttcacaaattttcacagtgagaagaatgacaattgaggtgcctaatctgttcttaggctagatttaaacgatgagatcttgaaactcaagcctgagtctgcttccataattagttgagaatctggggagacttgggagggagagggtatattctgcaggagaagatgtaagtaatttatgaccagagggtagattaaggtgaattaaaatggctgaaaattctttgacgctcttccaatggggagattgggtacatgactgctccccttgtcctgggtgggatctatggctgttttgaccaaaagaatactccagaatactactatgccagttctggtatcaggacttaggagtctatcagcctctatttcctgtctcttaaaagactcttggagccctgagtcaccttgtaaaacatgaaacttaaggcactcattctctaagaaagttagagaaagaaagagaaagagggtgggtgaggaagaagggaaagagagagaggggaaggcaaaaaaggagagagaaagggacacagagccaatgggaaaagagaaatgtctgtcagtcagtttggtctgccataacaaaaatcccataaacttggtggcttaaacaacaacagtttatttatttattatattaattttttttttgagacagagtcttgctctgttgcccaagctggagtgcagtggtgtaatctcagctcactgcaacctcctactcctgggttcaggcgattttcctgcctcagcctcccaagtagctgggactacaggtgcatgccaccacgcctggataattttgtattttttagtagggatgggttttcatcgtgttagccaggatcgtctcgatctcctgacctcatgatctgcccgtcttggcctcccaaagtgctgggattacaggcgtgagccaccgcatcctgcccaaaaatttattattttttttatttgtgactgctgggaagtccaagatcaatgtgtcaggcgctttagtttctggtgagagctctcttcttggcctgcagaaggcagtcttcttgctgtattttcaagtgttggggttgggagttggggaaaagagagagtgcaagctctctggcctcttatagagcacttgtgtcatcaggttgacctcatccccagcatgacatcatctaactctaatttctcccagaggtccaacctcataacaccatcacattgggagttagggtgtcagtatatgaaattgagggggacacaaacattgagtccataacatctggcccccatatatcatggagcagagataagctctccctgctacactttattcttaacttatgatctaggaaattgtgaaataaaaaaaaaaaatagtggggtgttttaagccactaagcactgagttttggagaaatttattacttagtaatacataatgaaaccccaaacagaagatgtagaaaggtcatttccatatcattctgtgaagcatccttttctatttagatcaaataagtgttccaaattcatttaattctatttcaattccaagttttgctgggcatgtatgaaaagtgaaggtctagctgttaacatgttgcctccattatcagaagcagaatttcaaaaacaattttatatcagtgttaccagatgcttcaaataaataattattaaggtaattcaattttaaattttaaagaagattgtcagaaatttgatttttaaaaagtgaaaattaaaaccatattgtggagatttctattcaggacacgaacaatagctcttatcagattaacctgcttatagatgaaagttttaaattctatacaaaatattgaaataaacaactacatgtaggctgtgaagagcaaacaaatgcagccaggttttggaagttgtttggcacatagatgaatggaactgcagttgggtgcatttccccatgttgatggttttcagcatgaagacagattccagtccatgctaagagacatgttaacttgttaaaacaaaacaagacaccagaaaaatagaacaaaatgaaaaacagcagagagccagggactggagaaatagggcaaaaaagcactagttgttccaaccatattctggtttaagattggatgaggaaagtaaaagagaggttatcaaagtaggtggttggtgtaggaaaactcaaaaggaagacggagtagagatttgagttagagctggagatgaaaaacagacatgctacagccatcttttatgtcgtatgtgcttgcttgcctggaattagtgttaaaaatctggacaaagtgtgagtctagcagagaacatcatagtgttgtacaaagtcaactccaggattgagaactggccttcaaatggaagagttaatatgtgatcgattttttttcaattcgatagtacaggtaaacattagataagtgacattactagatctaaaaataagcagtttagcctcgggggggccctgagtgtctatgctttgctttttcttaatacttgcattttgaaatttaactatcttatgataaacttgagcagaacaaatgaaatatgtctgtttttagtacaatttttatataccatatataaaagggtgtttacaagcactgtataataactatatgagagatacttatgtataactatacatattatataatatgtatatataactatacataaaactgtagatatgtataactattgagagagattataaaaagatataaatatgctttttaaattaaaacaccttattatatattttaatgaccaatatgaaaaaatcaaataatatactcagtaggtcataatgtttgcttaacatcattttagaacattataaaaataaagcaattcctagttttgactaaggacgttggctgacattttacttccaacatgttacattctgtctttatatttttaaacaatggcaaaaactcaaaatatgaagagccaagctgctctccttggctctggatatgccttgctttttggatttcagtcaaaaatttcacaccagtgcagcttacttttagattgttactttcagaagtgggcataatcccatttgtgtagttcagatgtacaacctgaagttctccaataactatgtagttgtttttgaaatgaatattcacacaacacacacttctcattggaaatgattctggtatggaagaaagagtggaagttttgaatcagtgtggacttgaattttggcttcatacattgggcaattgacttaacctctccaaatcttattttcttgagtaaaaagtgggaatggtaatgttcaccttacgccagacatagtatctagctgttcataatcataaccataaccatagccataatcataataatgaggaggaggagaaaaaggagtagccacagcaaaagaagaagtagtaataatagtgctactggcaatggaagtagtgttaataatatttacagtaatatttattgagtcactcctgatgaaccagcactatttgaagtataagaacatataaatcaatttaattcttgcagcggctctacaacactttagataactaaagtagaacttggaaaaggaagcagaaggatcatatggaactgcagaggtagaaaaggaccagatcgctgggcaaggtggctcacgcctgtaatcccagcactttgggagactgaggcgggcggatcacgaagtcaggagatcgagaccatcctggctaacatggtgaaaccccatctctgctaaaaatacaagaaattacccgggcatggtggcgggcgcctatagtcccagctactcggaagactgaggcaggagaatggcgtgaacccgggaggcggagcttgcagtgagccgagatcgcgccactgcacaccagcctgagcaacagagcgagactccgtctcaaaaaaaaaaaaaaaaaaaaaaaaaagaaaaggaccagatcaagaaagattgctgagaaccctgagctttactgaataggtgacagggatctaccaaaggtaattaaataaaaaaactaacatgatcagaaagaaaaccccgggagcatattgaaggcagcggttagtaaagttttccgggtaagaaaaagtgcaggactgaactaaagcagagaccgtgggatttcctttttactcagtgcttctatctttggaaatttacctttctccatggctgaaataaatagactgctttattttcaattgctttttaaattaggttttaggagaataattaatctgtaatatattatgacagtgtggctataattaatttttatatttgttatctaatttcaaaaagtttataattattaatttggaatctgtatatatgctacactctttagttaaaagtttgtatacagtcctttttttttaaactctgtatcccagagcacagtgcctatgtctggaagatgagagacacagaggaagacagagaaaaagagtagagaaaggaaaggagagagagacagaagagggaaagcaaaaagcagaaaggaggagaggctgatcaaaataaattacatgatgcagagttttgctacaacatctggcgttctttggattattttttgagggaggtagaaaattcctttagtgtgtaaattaatgctgtttcttggacagttatttggccttggatgccactgaaaaatcagtgagagtcccatagggaacacgtttacgtgtctcttgactgaaacgttagagtgaaagtcagttaaagagcatagtcaaataactaaacaccaaatggggttggatgattagttaaaattatatttaagaagaatattaagtgtaatcacaaatatgtctgtaacacatattcataaaaagtgactggaggacagtagaaaaatgctaacttttttttatcttaggggactgagatttaatggttcttttatattcttcctttttttccttgtaatgtgtttgtattactctgataagaaaaaaatgtaacaagaacaaaaaatttaaaaattctcagattgcggagacagattaacctcttgtaatgaataaagctctattttaagttgcttttcagttttatgaaattaagcttcaaattcaaggctttaaaattgcgggaaaaaagttcaggcttttagagaattcttcctcagaatcgatagttatccactactagacacaagcagtcacaatgtaaacagccctatgtgcaaactattgtggatatgaacagtaaaaccaaaagactgaaatgagaatccagtacgacagccaagcttgccaaagcatcacatcccagtagttcatcaaggtcaggtatggtttcaggcaagactccagggcagtccagtctactgggtaaggacatctgatagaggagaatctggcagaactctgagaccattctaagctgattttctttgctgacagcactctcactcacttagagaagtggactcagtccccgggataaggccctggcaagagctgtacagaagaacctgaaccttgcccagtgggatgtgatatgggacaaaacacgattctgtgggaaattcaactattatgagaatgaatcatgttagttatgatatgtggtgagcaggtaatgtatattgaagaggaggagaggtggagagagaagatgtggagtaaagacaagggtcaagcctatagatcatgccaaccaggtagagagaaaaaatattgtgactcagaaatgtctacaaggatattcagggtttatccttggcatacaacatctggataaatctcttgtttctgacattacctgaggccagctcataaacttcaggtgtgacctgtcaaggccaatctcaaagtatcaggaagcacaaaggcaggaacacaaagtctgtgcttatccgcacaacaaaagccattcttcagaatgtctaggcatcttcctgccttgtctaatcacagaacggtgccactgagagtgagcatgactgatgccccaatggagaataaggagaaggattaaaacagaaatttgagacttggagtaagtgggaaaggaattaaagctatccttttgtaataggaactttgttctatttgacctttcaacatatttatgtattagacaagacagaggcttgagacaagcctgagacaagcttaagacaatgctctacttcaaagcatcatcaccatagtcgtctgtttcaggggaaggatgtgggtagtggtgagcagagacaacctgggatagatgcagaagaaaaaattcaggacaagctgtgtagaatcaacagtctttacagaaaacaataggcagaggtctgtgcaggaaaatgttcctgagtctactgcagatagccgtagcctggggtcttttgttcagagatggggctctagttcttgggatctaagttatttgacataattactttagctgttatctataacaaagaactcacaaatcttaaaggcttaacagaaaagaattttagttctcactcaaaatgcatgtgaagcaaatttagcagccctctagagcagctttttttcaagcagcaacacagggaactatggcacaagtaatttcttctgaacctgcagtccaagttagatgaccttatgtcatgtaaccctaaactgtcctctattattacatctggcttgtgctgttgtattgctgtgagatttctcccactagactgtgaacttctaaaggcagcaactatatctttagtttgtgttagaggtagtcaaaaatgtttgaggcaggaacaaaaatggaaggaagactgatataaaggaagaatatataaaacaccaatttaggaaattcaagtgcatgagcatgtcacttgttaacaataggaaaacaaggccaaaattgtagcaaataaaatatacctcatataagtgcctactatatgtcacacactgtgctagacactttatatagtttgattccaatacatacattcataatttgagacacatagtattatctctgttttttaaaattgtctgtattagttcattttcacattgctatgaagaagtacctgagactcggtaattcataaaggaaagaggtttaattgactcactgatccgcatgtctggggaggcctcaggaaacttgaaatcatggcagaagttgaaggggaagcaagatgcatcttacatgatgacaggagagaggaagagtgagcagggaaatgccacacacttttaaaccatcagatcgcatgagaactcagtatcatgagaacgtcatggaagagaccacttccatgatcctattgtagcccaccaggtccatccgtcaacatgtggggattactattcaagatgagatttgggtagggacacagaacaaaatcatatcattctgcccctggcccctcccaaatctcatgtccttctgaaattttaaaacacaattgtgtcttccctacagtgccctgaagtcttaactcattccagcgttaacccaaaagtccaagtccaaagtctcatctgagacaagggaagtcccttctgcctatgaacctgtaaaatcaaaagcaagttagttacttcctagataaaatggaggtacaggccttgaataagtgctcccattccaaatgggagaattggccaaaacaaagggactacagaaattccaaaacccaacagggcagtcgttaaatcttaaagctccaaaatagtctcctttgactccatgtctcacatccagggcatgctgctgcaaggggtgggctcccaaggccttgggtagctctgcctctgtggctctgtagggtagagcttccatagctactttcacaggctggtgttgagtgcctgcagtttttccaggtgcacagtgtaaactgtcagtaaatctatcattctggtgtatggaggacagtggccctcttttcacagctccactaggcagtgccccagtggggacttttgtgtgggagctcaaaccccacatttccactctgcattgtcctagcagaggttctccatatggcctggacatccaggcatttccatgtatcctctgaaatctaggtggaaactcccgaagcccaactcttttatctttgcacacccacaggccccacaccacacggaagctgccaaggcttggggcttgcactctctgaagcaatggcctgagctgtaccttggccccttttagccatggttggagctggagtgcctgggccacagggcatcctgtccccaggctgcacaaaacagcagggccctgggtctggcccagaaaactgtttttccctcctcggcctctgggcctgtgatgggaggggctgctgtgaatatctctgaaatgctttggagatgtttttgcagaaggtgaagaggaagcaaggcatgtcttgcttgatgacagtagagagagtgagcggggaactgccataaacttttaaaccatcagatctcttgagaactcactcactgtcatgagaacagcatggggaaaactgcccccatgacccagtcactctcaccaggaccctcccttgacatttgggaattacaatttgagatgagatttggctgggtacacaaagccaaaccatatcaatgtcacttagtgaaactaagtgactaccaagttcactcaggcagctagcatttggtattcaaattcaggactgttgacctaaagcttctgtgtgtcttaatgttgactaatttgagctggtaatctaggtgtcttaaaatcactgttgcttagaaagaggttcagtcttcaggttgtgggtgaagttgaatgtgttggtgagagttcaatggcctcagggggcctcatagaaagaaatgcagggttagagacctacccagagctatgttgatctttataagaaaaaacataagcctctggggtcaacttgatctttgagattggagaaattttgtgcatttatcctcttgatgaaaataaatcctggcatatttggtgttagaactcttagattgcaagtaaagaaagccagctggagctaacttaagcaaaacaggacagcaaattataatgtaacaagggagcgtcacagagtccaatgagaagattgcagctgggtcactggaaggattggaattatattctgggaatagaaataatcaataactcaggaggaaatctctcttcaccttcactcttctctgtacctacgtttcttattttctctacggtttagcttcctctgctcccctgtctacagagccacatgtatttcccttacttttatttatttctcattaattttaaataccaagagaaaagactccaattagctcagcttgtatcaggaacctacccctagatcaattaactctggccaggaaggagagaaatggtgtacttcaggtaatgaagtgaatcatatcctaaaaaatagacaactaatccaggtgaggtggctcacacctgtaatctcaacactttgggaggccgaggtgggtggaggtttaggcaggcaacctgaggtcaggagttcaagaccagcctgaccaacatagtgcaaccccatgtctactaaaaatacaaaaaaaaaaaaaaaagtagacagatgtggtggcacatgcctgtaattccagctactcgggaggctgaggcaggagaatcacttgaatccaggaggtggaggttgcagtgagccaagatcatgccattgcactccagcctaggtgatagattgagactccatctcaaaaaaaaaaaaaaaaagaatagacatctagaacaagtgaagatcaactaagaatgtggtattatggagagagtgagggaaaggaaattatgggagccctgtgagttagatagatactctgaagacatctagtatgttgacagtacttacagcctacagctggaaagaacatgggatttggagccaagaaaatctggatttggatattgtttaaccttgcacagatcatttaagctcaatttaacataaacgcagatctgttttttatttgtaatattgtagtataatttttacttttaataactactgtgatgtttaacaataaaatatgtaaggtagctaggacacagtgagtgctaaaaactgatatttgccattacagttcttttcttgtgtttttgtttcttctaattgttttatctatgtgtaaagcaataacttcaaaattgagtgaaatgggagccattatcctatgactattacccacataatttcttcattatgtccaatctttgtacattgtgtccagtttgataaacagctctgatttattttcctgtcttgaatatatttaccagtgaaagctttccagtgtgtcactgaagaatgaaagcattaaactgtctggagacagaacttaagaatttgtgtatctcctttggccacagtttatcttgttttaaaagtgattgttggttgatatttcgtcttctgttcttttgctagcttcttcaagaatctttagtttataaacatctcaggatatacctggagtaaaaatcaagtaaactatccaaacatcatatgtatgtctttttaacaagtaaccttggctttagggctgtctaggatctgttcccaggtatttaactacttaaatatcttccagtattattgcttatatggtacagtgaaggtctgtgtaatcaggctacttcactgagtttctcaatgcattcctttctttgcttactccaacatccagtttggttttagttaactagattacgattataaattgaacacatttatatttccttttttcttccttaaagctagtcttattacaaagtcatattaaaaataaacacaaatatacctgcaaaaacccctgaaaaggaatgtaaatgtttactgaggttgtcttgaggacactgagagagggattagatgcaacatcagacacagaattttctatcaatcccagttatctattcattactacccctcaaaagtcaaatttatgacagccacacacatttcttcctcgtctttttttttaattctttctctttctacactttctggggatttgatttcttctgtttgtattcttatcttctacctgttcacaaaacagaagttgtctttattggataccactcttcatagaaaaggagggagaagggacttgtgagaattgttgcttaatattttgtcctatcacataataatagtatccagcataattcaagttatagtgataaagatagatagataaattgattgatttgtcagtcagtcaataggtagatatattggctggcagatagatagattatattagtccaatttcatcctgctataaagaactgctcaagactgagtaatttataaaggaaaaaatttaattgactcacagttcggcatggctggtgaggcctcaggaaatttacaatcatggcagaaggcaaggaggaagcgaggtaccttcttcacaaggcagcaagaagaagtgctgagtaaagaggggaagtgtcccttataaaaccatcagatctcataagaactcacttactattatgagaacagcatgggagaaatcatccccatgattcaattacctccacctagtctctcctttgaaacatggggattgtgagaattacaattcaagatgagatttgggtggggacacaaatctgaaccatattattctgctcctggcccctcctaaatctcatgttcatttcacatttcagaaccaatcatgccttcccagtagtccctcaaagtcttaattcattccagaagtaacctaaaagtccaagtccaaagtcctgcctgagacatggcaagctgctttcacctaggagcctgtaaaataaaaagcaaggtagttacttcctagatacaaggggtgtacaggcattgggtaaatacccccgttccaaatggaagaaattggccaaaacgaagtggctacaggccccatggaagtccgaaatccagtggggcattaaaatcttaaagctctgaaatgatctcctttgactccatgtctcacatccagttcacactgatgcaagaggtgagttcccatggtcttgggcagcttcatccctgtggctttgcagggtacagcccctctcccagatgtttcacaggctgccattgagtgcctgcagcttttccaggtggacagtgcaagctgttggtggatctaccattctgggttatggaggatgatggtcctcttctcagagctccactaggcagtgtcccagtgtggactctgtgtgggtgctcttaccctccctttcccttccacactgccctagcagaggttcttcatgagggctccatccctgcagcaaatttctgcctagacatctaggcacttccatacatcctctgaaatctaggcacaggttcccaaacatcaattcttgacttctgtgcaccctcaggcccaaaaccaaatgtaagctgccaaggcttggggctttcagtctctgaagcaacagcctgagctatatgttggccccttttagccatatctgggacacagggcatcaattcccaagactgaacaaagaagcaaggccctgtgcccagcccacaaaaccagttttccctcctaggcctctgggtctgtgatgtgggggctgctataaagacccttgacatgccctggagacattatttctgttgtcttgctgattagcatttgactcttcattacttatgcacatttctgcagcaggcttgaatttctcctcagaaaatgggattttcttttctattgcattgctaggtggcaaattttctgaacttttatgctctgcctcccttttaaaaataagtttcagttccaaactatctttatgtgaatgcataaaactgaatgcttgtaagagcacccaaatcatctcttgaatgttttgctgcttagaagtttcttctaccagataccctaaatcatctctctcaagttctaagttccacatatttctagcgtaggggcaaaatttcaccagtctctttgttaaagcatagtaagagtcacctttattccaattcccaaaaagttcctcatctccatctgagatcacctcagtctggacatcattgtcatattactatcagcattttggtcaaagccattcaacaagtctctaggaagttgcaaactttcccacatctttctgtcttctgttccaacctctgcctgttacacacttccaaagtcacttccacatttttgggcatctttatagcaacaccccactctctccagtcccaatttacttctataaagaactgcctgggactgggtaatttatagaggaaaaaggtttaattgactcacagttcagcatggctcgggaggcctcaggaaacttacaatcatggtggaaggcaaatgggaagcaaggcacttctttacaaggcagcaggaaagagaagtgccagggaagagccccttaaaaaaccgtcagctctcatgagaactcacccactatcatgagaacagcataagggacactgattctatgattcaattacctccagctgctctctccctcaacacgtggggattatgaggattatgatgattacaattcaagatgatatttgggtgggaacagaaagcctaaccatatcgtagatattccttatataagacttgaaaattgatattttcatctctgttttataaagaaggagatcaaagttcagggaaacatgttcagtattaggaagtagcaatgcttgtggtgatgtttatcccagttatccaggtttgatcattactcattaaatgcttgcatcaaaatatatcagatgtaccccataaatgtgtacaactattatgtacatataaaattttaaaagtttaaatgcagtatgtttttaattaattgacagattctaaaatgtatatgaatgttcaaatgacccacattagtcaaaaaaattttaaaaagaaaagcaaagctgcagaacttatacaagctgctttcaagacctactataaggctgtattagttatgacaatgtgttattgacataaagattcatgggaagaataggtggcatctgaaatagactcacgtatatatggttaattttggaaaaaggtataaatgtaactgaatggagaaagagaatcttttcaacaaatatttatataaaactgaatattgatatgggaaaaagatgaacatcaatcttgacctcatacaatacagaaaatattaaattggaatagattatagacatgaatataaaatctaaacatagaatttatagaagaaaatgtaagacaaattcttgaaaccttcaggtggtaaatattgctcatctagcacacaaagattataatcctccataacggataaatttaacttttaaaacaattaaaactttggctctacaatggacatcattaagaaaataaaaagacaagttacaaaatgggagaaaagatttataaaacatatatatctgtcaaataacctttatccacaatacataaagaacagttataacacaataagaagagaaacaacccaaaacaaaaatgagcaaaacattttaagaaacattataaaagaaaataaaccaatggccaatgagcacagaaaaagtgctcaacttcagtgaaatgcaaatgagatacattgcattacacattacaaatgaggtacattacatatccattagaatggccaaattaaaaaaataataataccaaatattgactagaagatagaacaactggaactcttattcactactcctgaaatttaaaatggtacaaccactttagaaaactctttggcagtttcttataacgttaaacatacatctacaatatgatcaagctattccacatctaggcagctattccacacctaggaatttaaagaaaagaataaaaagagatgttcacttagagatttgtatacaaatgttcataacagctttatttgtaataattccaaactggaaagtgggatgaatctaaatatcactccctaggtgattgaaattttaatcatgcattatattcatataatggataactactcaacaattaaaaagcagaaattttaatctgcataacagtttgtattaatcttgaaatcattaagctgaatgaaagaagctatacacataaaatatgattctactcataaaaatgcagaaaatggaaactattttataatcaaagaaaacaaactagttactgactaggaccagggtgggaacaattaattggaaatagcacagggaaatgttgtgtggtgttctcaccacaaaaatgttaatgtgaggtaatgcatttggtaattagtcagattaaaccatttcacgatgtatttatatatcaaaacatgtacatgcaatgaatacacataattatatctgtcaattaaaaaataatactttttttttaaaaaagaaaatgttctgtatcttccttgtaatggtggttgcattagtgaataaatttattaactcttcttggaatgtgcccttaaagtgggtgaattttactttatgtgaacctcaatatgataattcaaatcttacataggagtatgaatcaatggtctgatatggtttgaaagccagagaaaattaggtaaactttctgagccttgatgtttctcacttacaatgtggattaatttacaactgtcatattgaaattaatgatataaccaaagtattatacctagaaggtactcagtacttgttagttcctttttccttacattattttaactaattacatagttttcctttgataggccttaaattaaaagaatcatttccaaaactattccagaaaggatgctaacttaaacctacttgacatttgtagtaagcaggcattaaacagtgctctatattgtatttaaggttaatacattttcagaaacaacttgttttataatggactttcttgagggtagaacttatggagaataaacagcatctacttaaagtgtgcattagaaagattttgacagatttgtatatccataaaccaccacagctaacaaatacagaacatttgcatcccaccatctttcccatttccaaaagtttccatgacctcagtgcagttcattctcctctggccccagggagctgctgatctgttttgttttgttttatttttaaatcgctatggattagcttgtatttttaaatttttatgtaaataaaatcatgctatacatatgtttgtgtgtctactttcttttatccatataatgattttgagattattcatccatgctgctgaatgtactagtagttagttccttttaaatgatgaataggtttccttgcatgagtatagcatgttttgtttatctcttcactcattgatggagtattgaattgcttctaatttgaggctactgagaagaaagccaccatgaacagtcatgtgtaattttttagtgtggacatgttttcattttctctccattaaatacctaggattggaatgtgtgataagaatctcttttaattcaatttctacagagaagaaaaacagagtaggtccaaataatgaacagttaaataacaaagcctggttatgtatcttctacacagtaaaatatggtcatttagatggcagcttttaatccatctgtttctgtaccagcctttcaccctcagactactttacgtttatatattctcatttatttttattctctcattgctgagcttacttttgcccttccttgaagttatcagtatacctgctattaagagttctgtgctttccagccaggcaccatagctcacgcctgtaatcccagcattttgggaggctgaggcgggaggattacgaggtcaagagatcaagatcatcctggccaacatggtgaaatcctgtgtctactaaaaatacaaaaattagccaggtttggtgacacgtgcctgtagtcccagctaatcgggaggctgaggcaggagaatcacttgaacccggaggtgggggttacagtgatccaaaatcgcgccactgcatttcagcctggcgacagagcaagactgtctcaaaaaagaaaaaaaagaaaagaaaaaaaaagcgttctgtactttcccacttattgggtctaatcagttatcctgggagtttgtatagctaagtgagttaagtttgttgtaagtgatggtgaaacaccgaatgagacctctctaccgtgagtcctaggaatacttagtttgatttattaaagggctttgtttcccttttgccttctgaataactgtggttgcctgggaagtactctgcaataaaatgtagataaactcctaaggactaattctactttccttggtagatacaatttttatattgaaaacaattaagtttacttttattttatgaataaccttataaaatcatctgaatcaacctcaaatatttctcaaattattttattttattttaaacttttattttggattcaggggatatatgtgcaggtatgttatcagggtgtattgtatgatgttgagttttggggtacaaatgatcccataaacccagttactatgtgtagtattcaatagttggtttttcaaaccttggcactcccagtaaaccccagtttctactgctaccatttatgttcatgagtacctaatgtttagctcccatctataagtaagaacatgtggtatttggttttctgttcctgttaatttgcttaagataatggcctccagctgcattcttgttgctacaaaggacataatttctttttatggctgcatagtatttgatggtgtatctgtgtcacattttctctaccaaatctacctacattgattccatgtctttgctattataaacagtgctgcagtgaacctgcaagtgcatgtttctttttggtagaacaatttgttttcttttggatatatacctagcaaagagattgctgggtcaaatggtagttctgtcctaagttctttgtgaaatctccaaactgctttccagagtggctgaacaaattgacattccctccagcagtgtataagctttcccttttcttgacagccttgccagcatctgctgttttttctttctaacagtaaccattttgactggtgtgaggtggtatctcattgtggttttgatttgcatttctccaatgatcagtgatgttgagcatttttcgtttgttggctacttatatgtcttcttttgagaagtgcctgttcatattttttgcctgttttttaatggggttatttgttttttgcttgttcagttgtttaagtaccttatagatcctggatattagacttttgttggatgcatagtttgtgattatcttctcccattctgtaggttgtctgtttactctatcagttgtttctttcgctttgcagaaactcttttgtttaattaggtggcactggacaatttttgtttttgtagcaattgcttttgaggacttaatcatattttttttttccaaggctgatgtcctgaatggtgtttcctaggttttcttctaggattcttatagtttgaagtcattatttaaatctttagtccatcttgaattaattttgtatgtggtaaaatgtggggacccggtttcattcttctgcatatgactaaccagttattccagcaccatttattgaatatggagccctttccctgttgcttatttttgttgactttgtctaagatcaaatggctataggtgggtggctttattttagtgttctctattccggtccagtggtttatgtgtctgtttttctactggtactatgccattttggttattgcagccttacaccgtagtttgaagttggatattgtgatgcctttggctttgttctttttgcttagtattgctttggctattcagggtcattttttgtttcatatgaatttaagagtagatttttctaattctgtgaaaaacaatattaagagtttgatgtgaatagcattgaaactgttggacaatatggccattctaacaatactgatttttgcaatctatgggcatgaaatgtttttccatttgtttgtgtcatctattatttcttttagtaatgtttcatagttctttttgtagtgatctttcacttccttacttagacgtattcctaggtattttatgtgtgtggctattgcaaatggaattgtgttcttgatttggctgtcagcttgaatgttattggtgaatagaaatgccactgatttttgtacattgattttgtatcctgaaactttactaaagccatttatcagttccaggagccttttggcatagcctttagagttttctagggatagaatcatatcatcagtgaagagagatagtttgttccttttcctatttggatgattttatttcgttctcttgcctgattgctctagctagcacttccgtcctatgttgaacagcagtagtaagagtgggaatccttgtattgtttcagttctccaggggaatgcttccagtttttgcccattcagtgtggggtgttggttgttggtttgtcataaatggctcttattattttgaatttcaagcatttttaaagatccacattcaaaagttctaataactttttatttcttagcttttttaaacatcttcatactacattttatttagagaattcaaactattcttttgctccttgaatgtgtgtttgtgtttgctgatagagtgagggatatatgctttgaagtataattcctaatattttgttttggcaaggttgtgcaaagaaacattatggaatctggaaattagtgggaatcattagtatatttcttataaattccgtaaaaatgacatgacattatacatctttacatatagcagaggaggaaataagacattttaccttttttttagcctcttcagggcaataactgtagcgcatgtctcattgtgtacccaatatccctcttccatattggggagctacgccttccccaacccttttcagttctaatgggactatcaagcactgtttgctccctgatcataatggtacaaactcattcctagtcaagcagcctacctcattttacacttcatagtaattggtccaagtaatgaacatagaaatggtagggtactttattatatccaatatataaatattatgagagaaagagagagagagaatgatgctttcttatctgtgttgttaaggtttaaagatgttgccttggttctgcctgtagcagaaaagagttaggtcaacattcacagagggcagagataatgaaagtcaagaaatgtaaagagaatcagacagacctgatattggtgagactctgaatataaatgttatatatttgaaatacacactcttgtactgcttatatatgttagctaagatagttccgttcttcactgcaggattttaacgactttattggctgctccctagctcttgaaactttggcttcattgatctcttctttctgaactgcttcttcttacccgatgaataccaacttatatactgatagtctccttacagatacccttaatttattttgttggaaaaaatgttcacctcttttaagatgataaaaattctcatagatcttacaaaataattttagatacatcaatacattacttcttatatgtttttaaactttttattcagtacctcatttacctgcattttatcttctgttcaaaactataatcaccttaaaacctagggttgtttggttacatctgaaaatttctctacagtatacagcacaatttcatattcataggaagcactcagtaaatggagtcaaaaataaataaattaaaatttaaaaatacaagatattttctacatgaacaactttccctaactccctgaaaaccatgtgaagtgactttcttttatgctctcagattacttttcatttgcttcaaacatagcacttctcacatggtttagaatttttctgttgactcatcttccttatttctttataatgtaattgaagactttacaggtggtgtttattatttgataccaacaacctaacacagtatctaagaacataatgaacactgagtaagtactttttgacttatgaataaatgcaatgtaatgcagtcctatgtaaggactacaaaatattctttaccatctaattttttacattaactctattgctcatcttttcagtgatttttttatcataatcacagatagatctttaaatggaaaattattaaattagaaattaagaaatttttaaaaatagagtatattttaggtgtcgtccttagagcactgtggatcagaggtctggtgaattactccacgtcacatggttcattaaggaccaaccttatttcctttccattattcttttattataccatacaacttttctatcagtattggattatccaatttggcaaaagtgtagagcagtgatttttcacatatttttccttaagggaggaggacgtgctgtggattcaggttttagttaccagaatgtcaaaggaatagagttcacccagaccaaatgctcctgacatgctcttgcaaagaacatgcagatgactattgcagatcatttttaaaaataggaattactacgatagaatccctaaataatcatattattttagtctgaatagatactaattctgatcatgtttttcttgattttattgtttttttttataagcaagtagcatctttgtcccccccccaagactttctgcagtcattgtaagaactttgataattgaattcctgtggtcattttttatagctgtccataaaccttttccaaattttggttggtatgaattaaggtctgttcctgttaaagtacaagcagtttgtttggattgaatgcttgtctcttccaaaaataggtttaatttttctttttatttctattctttacttgttactaactacaaattcttaagtgtgtttcaacttttatgtcaatgtttttcaaagttgaaaaaccctagctctgtttagccaatttatttaatcttcattattttgggatttagtttgtgtgtttgttttccgaagagatttaatgtaaaagtgtctatactaacaatgcttttttgaaattgctttattaaggctagatatagagtttttaagttaattaagtctagttaatatagaattttacaaatattcctccatagatttcactttatttattcagtaaacatttattaagtacttgttgttttccaggctacacactgggtgctggccttacagtggtacacaagatcaacataatccttatttaatggtgtttatttcctcatgagaaaagtatatattaaagaaatcacccagcattttggcaggctgaggtgggaggattgcttgaggccatgagtttgagaccagcatgggtaacatagtgaaactttgtttctacaaaaatgtttttaaaattgaaaaaaaaaaaattagccagttgtggtgtcatatacctagctactcagaaaacagatgggagaatcacttgagcccaataattcaagactgaagtgagctatgatcatgcctctgtgcctctgtactccagcctggatgacacagcaagaccctgtctctaaaaatgaataaataaataaataataaaggaaataagcattaacaaagggtacagggtgcttttgaagcacatagaaaaagtaaaggaaggattgcttggtcaagtaatgtttaaccagatatcaatatattgatgagcggtcaaccaaataacttaaaaacttgatgaacttaaaaactcgataatccagaccttaagaaatatagcaggacattttacattacttttaataatcctggccaatgaaataaaaagtttttagaaaaaggtccttgttagaaacacatttttaaatatgtctgacatatactcttagatataatacagttatgacttgaataacatcaaagtgacataagtgagagtatttctggtaatggtggagagtggtcatttaagccctttgcatatttcaattacgcattgaaccgaatattaaaaataattattcaacatcttagaaaacaagaagaatgaggagaagagcaggaggaggaggaggaggaggaagagaggaggaaactgcagccatcactgccattgagtttgttttcgaaaaactgtagctgaaagggcaagcattgcatgtttaaggctttctggcagaaagaactccccaaatacccacgatgctatcaggcaagaacagcagacacccctagacttactggctcaaagtaccaaagaattgtgtttatgactgaaataacagctggaagttcaaaggggaaaaatccggcattgaaagaatttcaggagtaagacccaaaatatgactataaaccctgcacaaataccactttgacagccagactttacatgcagataagaccctcaaggatcctagtaagaaatgcagtcagagatcagataggagcctacacttgaaaaatagtgctgaaccaggtaagatatgagtttgctactttttaactgagtgaattcctcagcagtatggagttcagaaagctgaaggcatcttatcttgagatttaaaaaaaagcctgagattgtcagagcagctgaaatttagagaggaatctagaatcaggaaaccatagttagtctgatgatagtataccttgacagtgtttttctttgtgttcatttgattagggcttgtgaagcatatcgagtctctaatttctattgatctatattcaattttactaaatttcttacctctttgaatttctcttaaaagatataggactgtttaaaaccaaaactgtaacattgtattttgaggtttataatgtatgtagatgcaatacatgtgatagcacagtactaacagggaagtgagtggaaatgtattgctgaaagattctgatttttttttaaggatgaagagaaatgacatcatatggcaactcagatctaaagaaattaataaagaacattagagatgccaaataaaaagtgaatatataatacataagaaatatcactgtagaaattaaaggagaacaaacaaaaagccaatgcaaattgttaggtgtaacaacaaatttattggatgaacttaacagtggaatggaggtggaagaagatgtagttaatgcaataaatgtttttcaagaaatttgggacattttcaggtaatttttttgcaacagaataaaaagcctaggaatagccgcacatgtatatggtcaactgattttcaacaaattacttttaagcaaatattgctagaacaacaggattctatctggaagaaaatgaatatctattaatcgtcccatgccatacataaaaatagatttgacatgaatcatagacctaagtatatatgctaaaattatagaatttctagaataaaaaagatttttacaatcctggtataggcaaatatttcttaaatagaacagagaaacataactattaaatatattaattaattgggatttacaaacattacactcttttaaaaagacatcattaggaaaatgaaaaaacaagacacagaatgtgaaaaaaatttgttatgcatgtatttgaaaaaaaaaacttgaatccaaaatatataaatgtaaaacagacacactgcaataagaagattttttaaccaaagcaataaagaggagaaaaatttgaacagatattttacaaaagaagctatataagtgacatagccataaacatatgaaaaagatgttcagcattataaatacttattagaactgctaaaaaaaactcacgctaaaaaaattggcaaggttgtagagcaaatggaactctcatacacttctggtgaagattttaaagggtacaactactttgaaatagaatttatcagtgtcttattgaagtaaatttttatgaaccaaatggcttagcaattgcactcctggatatttacccaagataaatgaagataactgttcacacaaaggcttgcacatgcatattcataaaaattgtatttattctagccaaaacttagaagcaaattaaatgtctattaacaagtgaatggatgaacagatgtcatgtcattttcattccatggaataatactcagcaataaaaacaaatgagctattgatatatgcaggagcatgcatgagtttgaaaaatattatgctgacctaaagaacagaaacaaaagagaacatataaaatgattaaatgtatacaacactcaagaataggcaaaattaacatatacatttcatccaaggaatgcaaggttagtttaacacacaaaaatcaatgtaatgcatcatcataatagaacaaaaaacatgatcatcataggagacacagaaaaagcattttataaaattcaataccccttcatgataaaacaaacaaacaaacaaacaaaccctcaacttaagggcacctatgaaaaacccagagctaacatcataagaagtactcaatgctcttcccctatgatcaggacaaggttatctgttcttgctaattttaataaacattttactagagtttgtagtcagaaaaactagttatgaagataaaataaaaattataaagaaatacaaattataaagatagaagaaaactatcttttttgtatattagttgattacatatattgaaaatcctaaggcatctgtgaaaaactgttagagttaaataaattcagaatttttagaataaaatatcactttacaaaaattaactgtaattctatacactagtaatgtcaatatgaaaatgaaattaagaacacaattccatttacaacagcattcaaaagaaaaaactactttagaaataaattttatttaaaaagtgtgatattcatgagctaaaactacataagaatcttgaaaagttaaataaaatttaaataattgaaaacccaccccatgatcatgaagcaaaagaattaatattgttaaaatgacaatattctctgtcttatttcgttctgtgctgctttaatagaatatcatatactgggtaatttataatgaatagaaatttatttaccttgtggttctagaggctgggaagttcaacatcaagtggccgcatctggtgaaggctttcttgttgggtcataacgtggtaaaatgggtaaagcttattaaacataaattgtaaccccataaatattatttttaaaaatgatattagtaacaggaaaaaattgagtagtagaaagagacatggatttatgttatggtttccttgcacattcattcagtgatcttcagcagattactcacccatctcaaacttgtattctcctctataaaaataaagataaaaatatatacatcacaggtttgttctgaggattaaataaaatataattttttcaaatgccatatttatgtcaaataggagtgtattagtcagggttctctagaggcacagaactaatacgatggattaaaaacaggagtttttaatctgcatttcttctggaggctatttttttgtttgactcaattgtattgcaaagattattttgcttatgtttgaaaaattatattataaataaataccttaatttctattgcatatcattgcacattctctatagctagagattttttcattgctttggatttttgttatttggttttcagtgagatttaaagtcaagtattccataggatctagtgagttaagacaaagctctgttggaattccttctatgaatgtgatttttttttttttagacggagtttcattcttgttgcccaggctggagtacaatggcaggatcttggctcactgcaacctccacctcccaggttcaagcagttctcctgcctcagcttcctgagtagctgggattacaggcatgcaccaccacacacagctaattttgtatttttagtagggatgaggtttcaccatgttggtcaggttggtctggaactcctgacttctggtcatctgcccgcctcagcctcccaaattgctgggattacaggagtgagccactgcacccagccgaatgtgaaaatattatagtttcagagagtttcacaaatattcctccaaagatttcagttaaatagcttacttcctcaacatattttcagaactgagtatgttctcagaactctgctagatgctactcatacagtggtgcacaagtcaagatagaatcctactctgaagttctttccctatctgtgttgctacatacagaccagtaactgcaagtataatcagtgggcaagaaccacaggatgttttagaagtgtatggcaaaggtgggggaagaatttaatggtcaagtgatgtttaacctaagattaagattaatcgcagcattatttacaacagccaagatatggaaacaacctaaatgaccatagacagaagaatggagttaaaatatggtaaatacatacaatgtaatattactcagcctaaaagaaggaaattctgccatttgtgacaacctggataagcctagagtatgttatgcttagtgaaataaatcagtcacagaaggatgaatacagcatgattctacttacatgagttacctaagaaggtgaaactcatagaatcagagaatagaatggtaattatcagggtctagagtgagggaggggaaatggggagttggttaaatggtataaagtttcagttgtgcaatataagcatattccagagatctgctgtaaaacatagcacttacagttaataatattgtattgtacacttgacaattattaagagagtagacctatatcaagtgttttattataaaaaaggaaaaggaaaaggacacagcaaattttggcaatgatggatatgtctattaccttgattgtggttcgtagttccatgggcgtttgcatatgtccaaactctttaaaatgtacacattaaatatcagtaacactttaataaatgtgttaaaaaagattaatgtattggcttcattaagaggaaacgatgcaatatataaggcaagctgataacatatcaggtaaaaaattcaaataaaaattttctattgagctcagagccaaattcagcaatataaacacctactaattacatctgtaatctgcaaacagagaagattgatggtcaaagtgagaagtgtgtttcttcaatatgtttattatttcagtaaattgtcctcgtcttaaaagacgtaggcctttttgtaaacaagtattgtgtgaggtatgtgtggactccaagagaaatctggagagtggctcttctctttggaaaactttactttgttcaggtaaaggaaagctcctgaaaacaagaaacctgaaaaataatttaagtgattctaaacccttaaatacactccaaagaagcaattttaggaagcttccactttggcttcaagagttggccaaatctgatattatttaaaagaggaaatagactatttctgacgcacagatatttgtaatcaggattctatttttgtcatcggaatttctgttagcaattagacggtccattgccttcaacaataacccctagttatgtaataccccaccagtaaaaccatccccagtactatgcattaatatgtggaatctaaagatgttaatctcatagaaacagggagtggaaaggtggttaccagaggatagggggaagagtaagggatgaaaaaaagagaaacgttgacaaaagggtataaaattttaattagactggaataatcagttttagtcatctattgctgtaatgcccacagttaataataatgtattgtatgtcccaaaattgcgaaaagaatagatttttaatgttctcaccaaaaaaaatgatgagttcatgaggtgatgaaaatgtgaattagttgattgaatcttttaatgatgtatgcatagatcaaaacatcacattgtactccataaatgtaatattaataatgattatttgtcaattaaataaatttttaaaattcgtaagaactccaaagaaacaatggtagcatacctacatatagcacgacacaaagaattatgtttagaaaaaataatgcaattacaaatatttcagaaaatgtttatctgggacttttgaagcaggaggaaaagagattgtgttaaaattaggagaaaatacattatctgtccttagatactgaggaggatgtactacaagaccagaggtaggcagtcttatgtagatttgttttaggaatggacacagctgaaatgctagaatgtaattttataaattaagcaattcctggatccaaaccgatatttctcaagtaatatgcataggtaccatgtaagccagaagcatgttgctgctaaaatggaaacataatcctatttcaaaaaaatttatcaaacattttaagtttataaaaagttcttgcttttttgttttctctgaatttttcttaaactattggtgtctgctattatttatctattctacactcaagtatagagtgtcttctgattctgtaaaaattacataatttgttagtaattaaaaatacagtattccacattcttttgcaagagtttctgtgactttatgttactgtcccatctgagcaatattgagaaccattgatttggaactgtagtaatctcactctatcatattcgtagttaagccagagaagatctcagaaatatggaagagtattttgtaagtttcatatttttgcctagggtgtgttcacctatctcagctaaggcaaatagaagctatgtcttggggcatcttttaatctctaaatagaaaatataagcttctttgctctgcatgatttatgaggaattttcttcatcttcttaataagtaactcaggctgtcactctgtaagatctgaatgagcagggtaccttctaggttacgcttgaaagtgctatcactttggaaagcctgaccatctccttcctgcctagatgtctaacaggtgcattgcacagtagcctttttataccttataatacaaccaatatctaactttttcgaaagaatccacagattccaaagaagaaagcaggaagtcatctatttaccactccgtaggttcaaattacctccattaatggaggctgtgtatattcctactacccatcattacccggtcatttctttgtcttgcaatacctagcagtgcctggcatagaggaggtagagaagtttgagtggacatttttcatctttatgtagagtgctatcagagcccttgagttgattacaatcagtggacacggacacatcgtgttttagttttccttccaacccctgattgttgtgtgttataaggcaggtcattgcaccttgctaaatctaaatggtttactttctgcccttgtggttcttttttctgtgctttcaaggctgattaatttcttctctgatatactctttcatcagatgtttggcaaaatttagtttaaattcattaacaaataccattctaaaggtcatgatggctttcctaaatctttatgtatttatcttacaatcactactcattttcctagtgtgtaacttgttgatggctcccaacttttatctctatctaaagtaagttgagtcttagagataggcaggggcagcactggactgaagaatttgtcttctttgtaatttcagacaattgctgcccctacaagtaccattataaatggcaattagagctgggcaggacagggagacagagagacccctgacagtatatgacattgcccttttgttccaatgaagtcaattcatattccagattgagactattttcaattaatcgtgctggttaatgtctaagagacactatctattatgttagtaatcaagatatattgtttcttttgaacttccaatatattttggccatgcaattctgttggaagaaaaatggtaattaggtttgctcagaatgatttattatttacaagtatattggtatattgtgcttattgtttctgattcaatttttttgaggaacagaattatattcattatttaaaaaataaaaacattttaagagtcatatgttcataaagttctcagtgacatcatgatttgaattgagaactaaattatgtttcctgaataataggaaaacaccatttttaaaaaaaatctctgtgctgagtctttctgactggacaactgtgtgcaatggaaactttgcagctttacaaacctggatttaaataacaactccgtcactttgttgctttgtgaacttgacaagtggcttcacctttcagatcctcagtttttcagtctgcaaaatggggttaattatagctacctgagaaagtgttttgagcactacgtaacacagcattgagaacaggcctggcctggtgccggggagattgtaggcgcagagttaatgttagtttcttttttactcccatcctctctccatgacttcttcctcatatccgtcctctccaaaaaatgtccctgtttgggcagtctctcaacatatcaaaaaatatgaaaagttatgacatgtcatttgtcacatgattatgttctatctcattgcttagaagctggcacgttcaaaacaccataaatagtttttaaagatataactgtctttattttctcaacacgagtaatcttagaaaggctcaagaaaagaaatatttcagagttactggtgattaaaattaccatcaagtgtactggcaagctctgaacaaaagtacacttgtgacctgggctgtctggccacaggtcagtcaaagagtgacacttgtcagagagctggcgctcatttacaagacatcacacctgtagtacagacatcctgagtgcggtgctttgggaacttcacttttgaggatgtttgtttttctacctaatgcaagtatgaattaggtagcctataaaccagtatgatattaagattctcatagctaacagtatcttggagggttacaagaaagtcagtttacataccaatagtttttgcattatattatttttaaaagcatgtttatttatttgatcttcctggttgtatatattaccaatgaatgggcgcttcgtataaaaataaatctccttctatataaactatgagggcaaatataacttttgaatgtgtttagctgagagagtatttggctatttggattttaattcctatttgtttagatgctttgacctttaaatgaaactttgacttttctaagaaattcttacgtttttaaaggcccatcactgctattcttggtggtaaatagtaattccctttagaagcttacctatcctgaactcaactttgaattatctaatatttaccatgtgcaaactactaggctgggtactgcagaaacataagagtaaaagagtcaatgaaaataaccataatgaagcagaatgttatacaagagatattctaaagtggaataaccacattcgttttggatactgaattgccccatgggatagatttgagaatagcttttagcaaaaagtcatttatatacctatatacacacacatagttttaatcttcattcaatatatatgtatatattgcaatatatattatgtaagtctgtgtgtatatgtgtattacattgttatatattatatgacatatgcattgtatattatgtgtattgtgtattattatatatggtatgtattacctattatgtgtattattatatattatatatagcatatctatacatggacatatacacacacgtaactttactgggtcatagttaacattaaaacatctcacaaactgcatttatgtaaaaggtacaattgggtaagttttgacatatggatacacccatgaaaccatcaccacaatcaagataatgcacgtatccatccctactaaacgattcctcaatcttttttgtaatccctctataacatccgttgctatcccagcccaccccagccacagaaaatcttcatctactttctataaatatagaatatagtttttattccctaggcatttgtgaaaaatggaatcatgcagtacatatttttatgtctgatttctttcacccagaataattactttgagattcatacatgttgtagtatgtatcgagagttcattccttttattggtgaatagtattgcattgtatgagtataccagtttccctgacaccatttaaagcctttttaatcttagccattctgataggtatgtagtgctatcacattgtagttttaatttacttgttcttaataactaatggtgtttagttatgtttgcctatgcttatttgcaatccatatatcttctttggtgaggtatctgtatttttcattggactatttgttttcttatcattaagtcgtaaaggtcttttatgtattttagatacaagttcttatcagacatatgagttacagatattttattcatgtctgtggcttctgtttttattctcttaacagtaacttttgaagaacagaagttatatactttaatgacctctaacatcaatttttccttttatagatcatgattttggtgtcatattttagaattttttgactaattcaaggttacaaaaattttctcctatatttatttctaggtattttatagttgtaggctttacatttaggtctatgatccattttgagttaatatttgtgcatggtgtaagatatggatgaaaatatttttcttcctttattttttcctttgttcctttcttccttcgttctttttcttcctttcctttccttttttctctttctttctttctctctctttctttctttctttcttcctttctttttctttctttctctttctttttttctttctctctctctctttctttctttctttctctctttctttctttctacaaatggacatccaaatgtttcaaaactgttattaggaagactacagtttctccactgaattgacattaaacattgtcacaaatcagtttccatatgtgtgtggatctatttctgcagtctttaatcagtttcattggtttgtttatctatacttacttttatatctatgtttatcaataccataaatatacatactgcctcaacatagaaactctctcaagacagtagcagggacaatcataaacctcaccctacttgttttccatttttcagggatcactattcttcatcacttcatgtccaatgtcttggaagccattgttttacatattttgtctgtttttatagttaatttaggaggaagactaaatatatttctggctttactattttatctggaagcaaaagtccaattaatggtaccataatattttatagtaattacaaataatgtacttatttcatcgaactgatatcagtcaagtttcttttacactagcaaattatccagctctaagattcctgttttctcctcacattacactcccatcaaataccacaagatgtttttagtctctttgccgcacatttcctccagttgtcccctcagtaactgcactctagccatatcagcatactaaatttcagagacctctcccatactaactactcctctgagtagtatctgagactcctctgagtctcagcttacatatcaggtccttagaaaggcctttcctggtcctcacactctcattaaagttacgcttacttttaatggcaaaaactgcaataacttttgcaccgattaatgttattatttatactgtttctaattatatgttaatttatttactcatttaacaacttatcgggctcattagaacatgatctcctcatagacagtgacttagcttgtctttccccactgcagaccaaattctcttaatgtattttgtgtctagcagggaagacagacattaatgatgtctaacttaaaaagtgctataaaggaaaaagttaatgatatttaagagtttataatgaggggacctaatattcctgtgttagggttctctgggaaaatagtccttcctctgagacttaaaaggtaagtaatagctaacaaagagtgattaaggcaagaaagcagaaattcctacacttagcttatagaaaagacgcttggtaagagagaaagatggggctagaaggcaaggtggcaaccaaaacccagcttgacatgtttgaaatgttgccataccaaagaagaactaatcatattctgtattgctttggggatcggaggtgagacaagggaattagaacaacaattaaagtcaaggaattttggcacagtatcaagaagatctttctaacattcagaattgtccaaaaaccaattgtcttctttaaaatgcaataaatcctccgaaactggaggtgctcaaagtttgtatgatcattgcttaaagatgcagtgaaacagatgtctgtattaattcacaaaataatattctacttacaaatatcctgatgtataattcacaatggaacttagactagcagttgaatacggaatcatctttgattcatcacaattttggtagaccctagtttccaaatatgtaaaaaatctatccatttctttccattgtaactataacaactctgataaagtcattgtctcttatcacctatctacttcagtagcctttgttctatttttcccacaccctctattgccacatcctgtctattcatccatgacagagtgatgtttttaaaagaaaactgataacattgcatccctacttaaaacatgtctattttgtcccatatattatatttttgtatggagtgcaaaatgtatattggattataaagctccaagtgaagtgacgctgtctgtctccccagtgtcattttatgccactttttctgtcaccctgtgtgttccagcaacactagcttgctttcagcaacttaattgggccaagagttctcttccaccacaatgaatttgctcatgctatttcctctgtctggacatcccttctgctaccactcctccttgtctggctattgtccttcagatctcatcttaaaaatttgttaatcagatatgattccatagcactcaagactacgaagattttgttattttgtaccccacagcattgcataccctttgtgtagaactttcctcaaatacaattaagtgttttgtgttgtaattattaccataggctatgtctttccacttgatagtaagttccagaaggatagaaggatagggatcatgtctatggtggccattcatctcagctttgatctagtatgatgtctaacccaaagtgtattgctcaattaatatatgttgcatgagatttcaatgttataggatggattgggaaatttgtagaatcacaaaactctagaaccagaaaataccttagatattgtctagcctgtcccattaatcttatacattcagaatttgaagcttaaaagtattaaattacttgtctaaagttaataaaaagattaatggcagagccagggttcagtggaagtcaggaattccaactccgaattcactgccctgtccaatatatcagaatacctctctaacatggcattttcaatctcacaacctgatttttttacttattgagtaaaacaacagcatgtccagtattaatgagctgaaaagaggaaatgtaatttgatcatcaatagtagaacgaatggcagtttttttaacattgtgttgaatattatactacagttatattattccaatgttccccatgcatatttcctgtttatattctgctagagaccttattaatgagtatcatcactcagataattaccataaatagaattggactcttttgttgtttaaattagtctgtatgggagagtctagttgaggacttatctctctgtgacctcatgatatttgggagtaatatcagtagtatagcatttgcaactgaaaatttggctatgggattccaaatatataaaaaggaattttaacatattttgctaacaagtgcctgtccacatttatcgaacacttactctactgttgttcttccaaatttgctgttaaaataaatgatttaaatagtctaggacaaagaaataaagataaagggtatttttcatttatataggccagatatgatgagtaataattcaactcttgaggagaaggtacaaagctagaccctaaggtgacaactacaattaatagtacagggaaaagaattgtgttcatttttgaagtgtttgaatcatacaaccattcttattttgctattttcattttgtgaattatttgactaattaatgaaagaaatatggattcattacaaagtcagttaagtctaggaatatgaatattacgatatattccctgaattatcaataacttgtgatgcaaacatttggcatgttaatatggctgtgtttctcaacatcaaaaatattcttctgtcatcaattcatattgttgtaattcaattatagcatttagagtattgactaagttactgtaacacgaaaattccaaaaatgatggtggattcatcaaaatgatagttttattctccctcgtgtaagagtcaatccattcttggctagcagggacctttgctccaggaggtcatttagcaatccagtttcttattgagttgctcaactatctcctagagcatagtcttatttgatcaaagagagttcatcagcacatttgtgttccaatctcatgaatggggaaacagagaaaatgaaatataagcaattttctctttaaccgataagactagaaagtttaacccattactcctactaatgtagtctcatgcccacacctacctgagtaggttgcaaaatgttgcatctagctgagcagttctgtgttccgataagactcgtggggttctattagtaagtggactaggggataattaataacaatggataggtatcagtctgtcagtttgcccttctaacaacccaggtgtccatgcaccctcatctttcttcataaatacactcaaatcctcttcaagggggcccacataaaatcttattcagttactgctgcagctgaaaatccaggactggagtgaaatatagtcttctctttcaggtctggaagtggctccttgtgctctggcatcaacttacaaacttacaagttacatatcttcctttgtcctgatatataatggtggagtagggacaggataactgcaacaaaaactcccattcagaaacataaaaactgaaaagcacccagctgtttctggctcacagtaaatctcaaattctcctgggtagaaatggtgaatactctccatcctgctgatgtattagttgtttgggttaaccagcctcttgttctgctctcagtgagtattttcttcgtccattgccccctgcagctttgactttacatatttgggaggttcttcttcatccactgtccacatcagaaggtggcaagagtgagtgttctctccttggttcggcttggaaggacagaggattgtgttagagagctaacaacaaaggtcgttgtataccagccttgtggttcttatgataataaaattctttcagacccttagtagtattcttgcttatttgcttccaatcacttccatgtggagtaaccacagcaaaaacaatcttttgagcaatgtctatagagtctatagatgctcccctttttattatcttctcttctctgctcatctttccttcccttaacttaatataagcgaccttaataccacccaaaactaccgctctttacctctgagctgactctgagggacaatctaatatcatgctcgttcatgctcattgggatatggaaacagttagcttttctacactctgaagtctcaaattaggggaattttaatctattaaattgcagatcacaggcagagagattttccattagcagagctttcttttcttttccatttgcaaatgggccacttcttgcctaactttatttcatgtctcttgtaacattttgctgaaagttccaagtagcagccaaaacataccaaaaatacgacattaaaaaaaatcctgttcccctagggctacagcttggtaataatgcagtatgtttccaagttggcatatgttttgtaatggcatatcaaaggacatcactttctagcctgtaggtcctttctacctgccccctaatgtgctaaactaatgtcatgtattttgttttttattatgacaatgccccacttgcaggaaccaatttctataataacaggctataataagttaagcagctataacctaaaatacggtgccttgaataaagcagtttatttctcataacattaaagaagtgaaccatataagtgggtagctacaactcatttacaaggtcatctaaatttttaatatcttatttcttcattattcttcagataatatctttcattatccttcactgtccttaaattcatgcttaaagcatatttccagcctgtgaaataggagaaaaaggaaaatgtggaagaaatttcctttgtaaaaggacatacacatctcttctgctcacatctcatttgtagaaacatggtcaatgtctaatcttgacagaaagagaggctaaaacaagtaatgactagttcacagctataatccagctgaaacttagggggttttgttgctaaatgaaagaagagcagaatgatggagaacttgcaggctatgtgctcctccagtgaaattccactgatatgaagacatttggttgacaaataattgaatcaccatataataattgaacacatacaaattttaagaaaggactatgaaagaccacaggaagcataatgctgccttctgtaggagactgaatcaaaagggtctccaggcaaaaaattgacagaactgacagaaatggtaaaaaggaataaggtacaaaactttcttcttaaccaaaaatttcaatagtagaaaagaatgcagaaccctaagatgcaagattattctccttttaaacatttgatcttacacaataatctttcaaagatgttgaatagtcctgatatgctaggcaacacataatagaatacattacttaggggagtgaattcttaggaggaatagtaatgaaatatgacaggcataacatctgaagtacagatgttacattctatgccatgtaggtaatttacctttctaatagaatcttattcctgtaatagtttttctctcaatgtaacacagtattgaagtccaaggttagaatgataaataataataagagaggtgctcaagcattatttttaaaaaattaaatatccactgattaaataatgaaccaggcattgtgctaggccctgggattacaaagattaattccacagtttctttgactggcagttgtctgattcccatggggaagacagataaaccaacgtattatacagtgtggtatgcactaacattagagacatttaagctattaaatcgatataagtaagagtgatccaattgtgagaatggaaacaaaaacaaaaaatactgtgaaattcccagccttaaatttttggagagtaggaaagtttggctgaaggctaaatatcatgccagattgttgaggaagaagacaagacaattgtcaagtttatttgtttatttatttatttctcttattcctgaacttcttctgtaacaagttctaacctaaaacctttgccacactgttggcaattagaatatttggtgaatgctgagttttcattttgaaaataacctaaactggtttcacatgttagacattaatttatttattcatttgttcattaaatatattttgagcacttactatgtgccaggatttatgtaatgaagaaaaatttcttgctctaacaccagtgcagcctctagttcactgagctgcagccaaaggacaaggggtgtaagtaaggaaatctctattccatggctcctacaaagtggactgcttgcaaatgacccatagtaaactgcccaggaagcaactagctaaaaataactagctacaaatgcctcttgcgagtgcaccctctaccggaggggtaaagaaacctcaccgaatgctacaaatgccgcttgcaagtgcaccctctactggaggggtgaagaaacctcaccgcaagccttatactgtagtgcttcatgaaattagatattatgaaaagcccattgaacttctgattcaaaaacttctttctagcatctggtgtgaaaaatttctcaagacttcaaaataggtctgggcttccagagtgcagctattggtgctttgcaagaggcaagtgaagacctatctagttaacctttttgaaggcacaatcctgtgtgttatccatgccaaaagtgtgacaattatgccaaagtgcattcaactagcatgccacaaacatagcaaatatgcttaagaatcccctgtgatgggaaacatttcatatccctcggccctcctgccgaattcttttcttcctattattagtcattctgaacgttatttttttcccatggggtccaaaggtacccaaatatatgcttgcaagtggaaaaatagggtacagaaatcagttatttgcagtttttctattttcatttgtatgtgaatttttaatataaacgggatgtgaagcattaacgcaagtcaacatacttcggtgaacaagtttcagcaattcaactttatagcaattataaataaacctgttaagttattctggacatttggattgacgttgggttggcaagtaaattttttactgacagcaactaaatgatgtttatataatttttatcatataatagattctatctttttactatacttttctaagttgtcccacatgcaaatacatgtttttaatgttatctatcttctgtgctgtgcctataagtttgttattaaaatacattaaacaacaacataaacttcttttcctcaaagtacttctagtctagttggagaaacaacctagaaaatgcaccaacaaatggggcacaataactactctgagagagagtggcacacagtggacgcaaagaagaggttcctgatgcagctgggaagagtctacatgggcctctagcaggagaagatactggtcttgagtttggagactaagtaagcatctccaggtaaggtgtgccatgaaacaagtaaagcatacacataaatggaaatgtgagaaaacaggatatgtttgggaaatagaaagaattaaagaagtacagaatatcatattagtgtaaaaaagaaactgtcagtgtgaaataattattggaagagaagtcaggaaatttagattctcctactgtctttcatttctttcattaaaaccattactgagaccctactgatgttccaagcccagtgtgtggctctgggaaaacaagaatgaacaaaacagacatgggatttgcctttgggaatttcacaatttagtcagatatagacagatatagtcattaatcaaacaagctcatcaataaatgtataaataaataccctctaagtgtgcaaagacgcagtagcatgaaggtgctcggtgagctcaatgagctgagaaaaaggctttaatttcctttctgtaactaaaagttatgatgctttccaaagcctcttccaattccaatgtttttatgactgtaaaactcatattatttaatgtggattctaatagtttgagtttaagattttcataatatattcagaaagtgaagtgagactatagaagtccaatcatatttcctcaatactttaaagctgtttgaagatgcaaccagaaaacatggattcgggtattaagaatattttttcagacacttctgtttaaaactttaagaacagtaacatttcacacacatacaggaattactgtgttaatagatgtgttcaggaaatgccatgcaagataaagcacaaatgatatcataaacaatagacacaacagtctttggagagtgtgcactgtcttggcaacacaaaggcctgctggtaaatctctacacacctgggatgactggggaaagctgccaaccacaactgcatttgtggccttaagcattagaactaagaacaggtagaagtcctggttcaacaatgactacatgaagtagaggaaggagcaggtgtattcgctcttggaaatctactacttaatatcatggttactttgggcaaggtagttcaagttagttactgtgcatatgcctcagttctgtcatgtataaaattagaatgaagaaaataatggccttacctaccttcctaccttatagatttaaggaacaaataaagaaaaacaataagagggttgctgtgaaatgacagagagaaacataaagagaggagagagagagcttctttggaagctgaaggcagtcagtatttcttacatttattttgtaaaaaatgaattttctttaataaacacagaagtgaatgtatttctgtgactgttgttttcagtttgcattttaaaaattgccctaattgcagcaaaatttgactagtctgtgttggtttgtatttattttttctctttttttttttacagctctattgatctatcattggcatataaaattttatatatttaaggtgtacaatttgatgttctcatatacatatacactgtgaaatgattaccatgttttttcttcttgaaattttattggtctatgaaatctagaagtttggaaaagtgtttaatgtagggcaattctaaataaaaattcattattattcagttttattcaacaagctttcattgaacatcttcattttgaagttcttaaattgccttcacatttgtaagccttattttccaacaaagtatctggtccttaagggcataaggacctctccaacgtcttcagaatttctcaaggagctaacccagccatgtgggtgcacggtagacattcctaaatgactgaatcagatgatggtctacacttgtttttgtgtagaaatgagaatgagtcactgtctggaacttgtcccccgacttgggaatgttaagcctttggaccacttttccctggctccctggtgggcctttcatccttgcaagggcctcagggacatgatggagtttccttttctctttaatgtccctttcggttactcaaacctctaggattcttttacccactctaccagtttatgctgcatactgggatggagctttcctaggttcctcttttctcttcctgaaaaaacacacaggctctttttacattgaattttaatactaatccctcctggtaattagacatgaaataacaaaaatggtaaactatatcaaattacaatggttaagaaatcttactgaattctatcaggcatgtttcctggtctataatttttgacttcttgagggaaatgctaactaggagtcccaaacatttattctttaaggtaaatttctccagaagtcttattctaaggctagcatatccaatcagagaaagaaaattaatatgatctaggttaattaggtgctatcctaggctaaataatagccacctaaagataacatatcctaatctcaggaacttgtaaagttactttataaggaaaaagggactttgcagaagtgattaaatttaagtatcctgcatagggatattatcctggattatctgggtgagccctgaatacaatcaaaagtgtcctggtaagagagaggcagagggtgatttgacacacacacagattgaagaggaggaggcaatgtgaccaccgaggcagagattagagtgatacagccacaaatcaaagaatgtcagcagccactggaatctggaagagacaaggaacagattctctttagcacatcagaaaagatggtgcattagttgcagtggctcacgcatgtaatcccaggactttgggaggctgagtctggtggatcacttgaacccaggagtttgataccagcctgggcaaaatggcaaaatctcgtctctacaaaaacaaaaaacaaaaccaaacaaacaaaaagcaaactaactaaaaatgaaccaggcgtggtggtgtgcacctgtagtcccagctacactggaggctaaggagagaagatcacctgagcttgggtggtcaaggctgcagtgagccatgattgcaccactccactccagcttgggtgacacagcgagatcctgtctcaaaagaagaaaagaaaatattgtgatctggtgaacaccttgattttgaaccaataatactgatttcagacttctgacattcagaactgtgagacgataaatttctgttgttttagcccatgacatctgtagtgatttgttagcacagccataggaaactaacagaagggcccacttgtcttaaattcctatcgtttaacctgtggggttggtaacatccattttaaggggttcttgccccgtttctttaccttttctggtcattaattgtcaagctgagcagaaactatttttatattactggagagttatgcttgagaaattgggatttgagaaaggcacggaaagaaagatgatatacttaaccactattccttcatctaataaacgttgtgtaaattcctactatgtgtcaagctatgtgctaagtcctagaataaaaatggagtaagacaggatttttgtccttaagaagttcagttgagtaggagaattagacacacacatatgtataattaaattaatttgtggaaaatgcagtaatgattatgtagaaagagtattgtatttccccagtgcatttcatattttgaaaaacactgtctacaaaaaagtttctgtgtttaagtaatatataataggttaagaacagttctaactgccaataggttttataattaacataggaagatcagtgttatactactagcttaccattatttcagccaaaaatcaaaggtatctgtcatttgagtttttattgtaaagtctgttcctggagaaagtgtgaattttcttataatatttaaaatactgatgtagctacagaactctctccccattactttcaagaatggcctttcctagtttgggaaatacagcaactatgtcattaaacaatctggttggccaggcacggtggctcacgcctgtaatcccagcagttagggaggccgaggctggtggatcacctgaggtcaggagttcaaaagcagcctggccaatgtggtgaaaccccgtctctactaaaaatacacaaattagctgggcgggttggcacatgcctgtgatcccagctactctacttgggaggctgaggtgagagaattgcttgaacccaggaggtggaggttacagtcagccgagattacgacattgcactccagcctgggcaacaagagcaaaactccatctaaaataataataataataataataataataataataataataataaaacaatctggcttagagaaaattgtattgcaaacaatctcattaatgagagttcctgcgtaacaggacactagctctgtcccttggggatggcttggagtactgtttcctggtaaagcaacataaacagatctcagtcccctcttacagagttatgaaataatagccataagtaataaccaacatttatataagcattccatcattttacaaaataattttacaaaagtaactgattataggttgttttaattggaagcaaacccagtttcattacctcaagcaaatttcttcatctcttttagcttccgtttctcatctcttttttttttttgagatagagtcttgctctgtcgcacaggctgggttgggtgcagtggtgcgatcttggctcaccgcaacctctgcctcccaggttcaagcaattcttctgcctcagcctcctgaatagctgggactacaggcgcctgccaccacgcccggctaatttttgtatttttagtagagacggggtttcaccatgttggccaggatggcctccatctcctgactccgtgatccacccgcctcggcctcccaaagtgttgggattacaggcgtgagccaccgcgcccggcagtccgtttctcatctttaaagtgagagtgctaacacgcacatggagggctactatgagaatggagtgagattttgtatatgaagtagcaaagacagagcctgggacttagtaggtacattattaagagttggagccattttttaaaccttttgtctttttgttatttttgctgttctgaaagtcgctaagcttttaaaaatggtctcttattttactattcttgaattgtttcacgcttctcaactcatgacaagaacctattctgccaatgaacctcctgcccccatctattgaaattaaagcttaggagcaccagtgcatcccagaatttgacttccttccagtggagagaccccttgggtttttcgtgtgctctttccctgatcctttaggtgtcacatggtcagaaagaacatagtattatttataaacaatatgctctctaacttcagaaagatttaggacagctttctggatttggtcatgcatgaaacaggaaaaacaggctattagaaaattgtgtgaagtctaacagggacttgatatgaattcattttgatttttaaaactgaggactgcaatcattaatcagttcattaaattaattggaataagtatattgcatgtagtgagagtagtagtattttttgaaattttagttttaattatatcctatggcctgtgttgtaagattttttattttaagagtttaaaagccattcgattaagcaactagtagtaaacttttctgtctctcattagttgttaaatctagaaaagttattggtttaacaaacctttattggatatctattttgcatcagatttttttctacatgaatgacatttttttctctctcttttctaatactgatttgttgcagtgtcgaataggtacctgggtcaactccacacacttctcactcttcactggacctctggtacaagattgagaggattcctattacttacaaacagactaggtattaaaacaaaaagattcccgaatagagtgaatctaagttcccctagagcccctaagaattacatcagctttaaccattaattccctgggttcttcttattcagtaatgtcttaaaacctttttatcagtatgggatgggcgggcaaggggataaagaaactggcggctggtgggaagccttaggtaaggctgtcaggggggctttagtttgggagtgggataatttgctgaggaagggtgggagaaacgtgaactagcacacaaaaggctgtttccggctcaaatttcgttaccaaggctctttgagatgaacttttttgggggaaaacaatcagtctaaaagagctgtgtcttcttgtgtgtgtgtgtgtgtgtgtgtgtgtgtgtgtgtgtacaagggggcggcgagggtccccacttttagtatgagtagcattgttcacatgtttgccagtattttggagcctggcaggcctgggtagaggctgcgggggacgcctccaagttcccacccgggacatcctgaacagcagcagccacaacaacaggctcgcccctagacaaaggggccggcgcggcggagcagactggtgcagcctgggccgcgcgctcagagcgctgggcgtctgggcagctgagtgggcagagctgacccggtgcgggtgggagtcagggcgcccggaaaacccggctctgggtagcagaccccgcccgggctggctcggcgccgggccttcgggcttccactcagtctttgaccctcggtcctcgctcagcggcccggcaggccgcacaactgtaaccgctgccccggccgccgcccgctccttctcgggccggcgggcacagagcgcagcgcggcggggccggcggcatggctgtgtcctggaggagctggctcgccaacgaaggggttaaacacctctgcctggtaggatggcgggctaggctctccttgcgttctctctgtcctgcagtgattttgattcattctctgagcgtgcacgggtgggaagctggaagtggaagttttgtcttaattcgaacattctcaacttaacaaaactttatgctggagataacaatgaacactccccctcccaccccctcgcctgtcccccaaatgcatgagaatttttctgcacattgatgggagagatgtggaggaagagggaagaggtcattttccgtgaatacagcttttctttttaccctttaaacatttttgctccctttgttcttttcccagattacttctgtttgcttggggtatggtgatgtcattaatttcttaatctcattttgtacggcaggggatagctgtaaatcatttaggaaacctatttgcaacccaaatgcttagtctcaggtgaaagggctgggtaaagtcagatttgttttcctctgagtggttttcagcttgctggttaattgaaaatgctttctgcagttactgatttaggttccattgaaagcactgtgtcgaagaatttacctgtggtttctattcatcaggtaataattattttcaatttttgttttctgtctctcatgtctgattggtttagttcatctggctctccatgaatgtcctgcttttctggaaaaccttcttgctgtataaccaagggccagagtatcactacctccaccagatgttgggggtaagtaagctgaacttggataatctggtggaatgggtttaacactggcagacattgctacaggtttggtcagttccattcattaaagaaatgtgcactcttcactttgaaaacctttgttgttctctaaagtggtcacattttcctgatttatcatttacacttgtacaagttaaaaagattgactctctcaagaaccaaaggtaatatctgctgaagtgaaacgaatgaacctgccagaccaggttattggtgccttaaaaaaattgctacttattgccagctgctaagtaccctgaaggatctgattcactaggaggatcaaccaataacaagcttttagtatatacttatcagtgcttttagcctgctcatgagcttatccagaggatttctgcactgtttgtttttactgacaactctcacaaaatatgggtctaatggggttattcatttctgggcagttctcagtgcttgctttgggttagtggctgatgatattccagtattctactataatatgagaaagatactgggcaaaacttttttctgatttattttatgttaatatttttctttcttttctatgatgtttctgatttcattcttctgttccatctccttcttatttgactgcttaacagaagatagtgtcactgaaggcatattactttgcacaaggagattgcgttttctttttctttctttctttctttcttttttttttttttgagacagagtcttgctgcgatgcccaggctggagtgcagtggagtgatctcagctcactgcaacctctgattgcctggttcaagcaattctcctgcctcagccttctgagtagctgggactacaggcacgcaccagcacacctggctaatttttgtatttttagtagacacaaggtttcaccatgttggtcaggctggtctagaactcctgacctcaagtgatccgcctgcctcagcctcccacagtgctgaaattacaggcgtgagccaccatgcccggctgagattgcattttctaagcaacaagcaaaaagtgtaaaaccctgcaaaaacttagggaacctgaaaaaatagattttgcattttggtgagtgggggggtgcagaaaaaaacacattttgcttttttattttttttcatggtttaatgactacttaaaattaagacgagctcagacaaattcagtggaaccagctctcccttctatgttttacatggagagatcttatttatctgtaattctcagtacccagactagtgattggcacatattaagcctgcaacaagttgcagttgaattaattaattaattttttatacaacaaagtaatatcataatctgttgatcacacactttataaagtttaacttctaggttttaagccaatgggttgaaaaaaatagtctgtaaagctaaacccatttcatttatttctttcatccatccaatccaggaactgtcttgaaacctatacatttcagatgggcacccagagagtaagacctcacctcgcccctcaagttgcttacaatataatggaaaaaccaacaaataaataattataattcaataaacaagaaaaggtttcttctaataaacacatgaggtctgataactttttggttttgttttctagtatttccccattaggtgtaagttaatgaataggacgtttttcagtggaagctttatctcatctattacataacttgatgaacaacttggagaaaactctttagatatagaatggtaaaatttgctctggatcacgaggtatttgtattaatataaaaatctaagaattggaaatttattgcaataacctagaaagccataactgaactttggattttagctttgtgagatagtataagctaaaataacatcttatttcttaaaaaaataattatttggaaaccaactcattaattttcatgaacttggatactgtataactgaatttcaaatttaatttggtggtaagtcagatatgattaagatcacatatgcacagaaacataaaccaacaaatttggaaaacatttaaactatgtttcacctctctacttccatcccacttcactgcttctgcttgaataacagacagggtaatgagcttcaaggactgctgacacatagggctcaataaatattgatcaagggaatgaagaaaaaaaatgataaaaggaccaaatggaagactaggagcataaaggataagaaacagattcaagaaaggagaggttgttataaattagtttttaagaacacacaagtataattatagtgagttgatatttgagctatctggtaagtattctccattttaccaagagtcactgtggacaggaatggtctttctacatgctgagagataaaatatgacttataaacttctcagtaattatctgttatgaattttccagtcattaatttatctaagctattttggaataggtattttcagtctgtatattaccttttattggaaaagaaactccttctacagttttactatctatgaaatagtgtttaattttatgtcctaggcttatcttttctaatcttataataagtgttgcattatttcatagagtaacaatttgcaggcacttttcaaattgcaaagaaatgcagtataacaaagagatagaattaatttttaaataaatattgctggttctgatgttttacatttttaagaactatatgttattaacttagcatcttagagtgatgcatcttagaacttagcaaacacttggtcccactggtatacgcatgtgggattcctgaagagagtcaaggtatattataagtctcttttaggtggattttaggtttgtaaaaatcatgatgttatttctggaaatgtatttcattgtaccatttaaaatgcaaatagaaacaatactttcatggctgaacattttgataatagctttgagtataaagttgctgtcattcgtctgtgaaatgtaaggtaataacaaagttgtactagtacaggaaggacccacagaatatggtccatttattggaagacacagacaatgagaaacagttaattcttagtaattgcttgaaaatctctattttctattgaagaatgactttttattcaaatgtttacttatacctgtgatatgccaggaattttacaaatgttttgtttaagctgggaaactgttctctctgttttacatacaaggaaatatgggctgaggaagctgtatgactcgctgaaataccttttaatggtcagtgtcagagctaggatttgaatacagccctgtctgacctctgctttttcatcatactacgtagcttttctaaacgacttcactggtccatgtcagatacttatactactggttagtattaatttttaccagtgctgcccaacagaaacataaagcaagtcatatatataatttaaagttttctagtagcacattaaaaaaaggaaaaagaaaccagtgacatttatttaataatatgtggccaactaaccaggctgtaaaagagacatcaggacatgggtagtcctcttgctcctcctctactaagcaggaattgtcaaaggatgggaagttgtggaactacaaaaattattggtttgggaggccaaggtgggagcattgcttgaagccaggagtttgagactagccagagcaacaaagtgagaccccatctttacaaaaataaaaaaaatatacatatatatacacatatatacacacatatatatgtatatatacacatatatacacacatatatatgtatatatacacatatatacacacatatatatgtatatatacacatatatacacacatatatgtatatatacacatatatatgtatgtgtatatatgtgtatatatgcacacaaacacacacacacacacacacacatatattagctgggcgtggtggcacatgcatgtaattgcagctacttggaaggctgaggcaggaggattgcttgagcccaggagtttggaggcagcagtgagctatgattgggccactgcattccagcctgggtgacacagctaaataaataaataaatatttaaataaataaatttatttatttatttatttaaataaataaataaaattggtatagaactataaaaatctccctgacttctgtctcatcttctgagttttctgaaggtgggaatctttgagaatgaaggtgaaagtatttacttctcagaactagagtatccacttttatttctgggttattattctcgtaataaaattaaagagtaaaaaaaatacatacgaattgatagaaaaaataagatcttaattgctagaagataaaatataacattgggattaatatgttttattgggggttctcatcatgattatccttccccagactggtctgatccagagtggaggcaacgtggtcatggctggtttatgcctgagttaatgtgctaatcagactgtgcacttcctaggagatgtttaattgtgacatgtcatgagttttggaatcttaaaattagctaagaggaaaaaaaaatctattgagagaagccaaaatgaacaccgaaacaagcaaaccaacaaaccaaacaatagcctgctccactcccccatggcaaccttttaaataagtcacttcattgattgcttaagattaaatccattttcatttatttattttcaagaatggaaaatgtagttgcctgaactttatagaaattagtaacaggttgtgttcaactctcagaaatgtagttttcttttctttttttggaaatattggagcagtttaactcaaaacaccatttataggagctcttgaattcatgtttacctgttttgagttgcgttttttacattttaataattaaagaatatcatgtaattcccataaacattttaacttgaaaagagaatgattttatgatatcagattcaatgtgtcttagttatatatatatattcaatgtgtcttagttatatatattatatttttccctccaaactattcaatttcaaactagttattcacatggtgtcaggataagattttaatttttattttgcttttattcacaaatattgttttagatctgctgcatgatcttgaagctttttttaaacttttattgaaatatctatgctcttgagcattcagattctttctagtgaaacactgggattatctttctttagtcaatcattatccattagaaacattaactaatttaccctctcaagagtcctagaagttatatcataacattttacagagacagaaatctgatgtcatgtgaatttcttaaggtcagagactggagtctctggacaaatggatctaggattttaagtcaatgttagtttcacagctggcctgggcagctttaattctgctgagaatgaatatatgatccctgttactttcagaagagatttggtcattaaatcctaattatacagactgtaaaatcactagctagagttgctcaggcacatgttatgataacaattcaggggacatttttagatgagtgttattttgcttatttgtttttattcttaacattctgttatttagacacaattttcttgtttattgatgggtgaaatgggttatatttctttgatgaaattatattctttatctatttacaatagacactgattcatagagttttagacttggaaggaaactttgatatctttacttaacttttcattttccgaaatggaaaaatgagattgaggtgatttgttcactatcacctactgaattagtgacttggtcactatttagtctattgttctccttagtccaatattagccactataatgaacagctgtatgaacacacgcaagaacattttaaaccccacactgtatggactactagctttacattttaggtgaaatgatactttaaaatgtctagcaatttaagaagctagcgaaaatgattgatttactctcaaaataaaatatatttttagtattatagttgtttgagacttgccaataaattgtgaaggaattatgagaatttttatttaaatttattctgatttcacaatacttttcagaattctaaggctcaatatttaacctcgttgtgatatatagctaaatgctaactgcataattctcctttatcaatatcatcccaaacagcatagaattggaagttagaatgaatctcaaagatagtcaaatctttattttttaataaatgatatgaataatatcaataacagattgtgctcagtgataactggctaatactagactttagtctaagagctttgcactgattaatttatttaattctctcatccatagtatggaaggcatgatttcaagtttttgttttgtagctgagaaactgagttagaggggttctataacttgctagtgagggacagaagcaggactcaagcccaaagatcctggttccagaacttgtattcttgttttataaaattttaattgacaaatgccaattgtatttattgtgtaccacattatattttgaaatatgtgtatattgtgaaatggctaagtcaagataattaccatgtatattaccttacatgcttatctttttttgtgataaaagcagaaaatctactgtcttagcaattttcaagaataaattgttataaactatagtcaccatgttgtacaatagatctcttgaacttattcttcctgtctatctgaaattttgtatcctttgaataacagctacccaaccccctcccacccccaccagcacctggtaactaccattctactctctacttctgtaaattcggttacattctttcttagatgacacatataagtaacattatgtggtatttgtcttcctgtgcctggcttattttacttaacttgatgtccttcaggtctcctttcatgttgtcacaaatggcaggatttccttcttttttgtaaagctgagtagtatcctattatgtatacataccatgttttctttatgcatttatctgttgaccaaatttgtattctgagccattgtgctctgttgtttctttgcaacattaatattaggttgaatcatatagattggtagatcagaaacagtcaaaaatcagccattttatatggctcaacctaatagcaactgttaccatttattgattatatatgacgtgtcagacacagttcttggccccttttataatctcatttaatccttatatttaattgaatccttgtaacaacagtagaatataggaattattgatttttacagaattaagaagcttagattaggaactatttgctttttacagaattgagaaactgagattctgagtggttcggtaactttctgagtagttaggttacatagctgactagtagagaagcccaggttgagcccacacctgtctgaaactgaacaccatgctctcaatcactctgctttccaggtgaggttctgaaacagatagtgttagaacctgcaattctctactgttgtctaaggtccttatacattttgccatggtggtgctgaatatactgtttgtgtttccctctgtttgctgtttgcatgttagtgtgctttttgtatctgttaagaagtatttgatcagaagtaaattcaagcatatatgcattattcttatatatgaggtggacttgtataactaatacctactctgttagtttgctagggctgccataacaaagtaccacagactgggtggtttaaaggaaagaaatttcttcatagttctagaaactagaagtccaagatgaaggtgtcagcagggttggtttcttctgagggcctctctccttgacttatagagggctttcttcttccaatgtctttgtatggccttccttctgtgtgtatgtcttaatttcttcttataagggcaccagtcatattggattagggcccatcccaatgacctcatttaaccttaattacccctttaaagattgtgtccaaatatagttacattgtgagttaaattcaacttggtacaaataccaactttgtcagtcttcctctggaagctaagcatgcattttgagaaattaatttgaagttaatgtatttttttttctccttaattgtagaagcccagctgagcactagcattccagaatgacatggcaaaagggtccttcccaggcctttttaggaaggtattgtaatgttcctccttagaggtttgtcgagctttattcttagccctaccctacaactattttaaacatgctcttacacaaccctttattccctccattacctcaaagaagaaaatcagataaattagcacctctgaggagtagcatcaatattttattttgattttttagatcttggcatcaagagtatgaattcagggaactgactcccagaaaaggaagtagggaatattgaggaactactttaccttgcacaccactgaggccaataatagtagcagtcgtcgtagccctagtcctagtcatagttgtatatactttcttctgggcaatgctcagcctggagggagaggagcctgtagaactgtggactgttctagtccatttaccctgtttgatggatgaatttcatatagttaaatgctttctttatggactcagtgcaaagctgaatgtggaatgtaggtcctctaactcctggtcagtgtttcttcatgtctatcatgctaagcattgtgtttatcataaaactgattttaaaattgcctaagtaattctggagagaaaaataattataatttcttactgaaaaggtcatgggctttggagccatatggatatgaatttcaattgtggttaagcatttctctccctttgtgattttgatatactattctctcagcctaggtgtaaaccctactcataaaatagggcttaagccctactcttagtttagatggaaggacagcatgagaaaatgcaggtgaagtgcttagcacttggtacataggcattcagcaaattgataactattactataaatattaaataatggtaattagtattaatggcatcaatattatgaatagaaccaaatggtaatattgtattgtgtatatatatatacacacacacatatatatataacatatatatgttaaaaagaattcagagacataaagatggaagggatttgctgagcatacagatgctgagcatatgagatgacacctaggacagagatttaccctttgatctattatttcagtgctcacaagggtgcttaataaatggctgtttgatgatgaggttgtatgtttgctcgtcagtaggaacatgttaccttcagtcctttggttgacctttggctgcctccctgatcctctggagagaggaaggctatttactgctatttgctattggcaaaaagtttgtggcaatttggctatgattgttgggtggaattttagtttgaggtggaacatatttcattcaacaaaacattacttaatactttttattaatcttcactgaatcttggaatttcaacagataaataagataaattacctatctcagattactataaattttaaagaaaattaaaataaataataataatagctagagctagctttcattgcaatcttttcatgggcctgacattgtgccaagttcctgttatgttctttgctgcagtctccactattctacaaggtaggttctattcatgagaggaagctaaagaacagaatttgtaagcaatttgcgcattgattataagcacctaacatgaagtctattccataataggagctgtaaaaatgtcagtcgtcttctttcctccctctgctcttatccttcacagcctcataaaataattcaccttactgttttataccccaggaaaacatgatggaaatattctacttatctcagaatattgtgctgagcattatgacttaatacataagaaagtagtttgaagaattaagtttcacagatgtggaagactgttgttatgtcgtgtttttgtctcctatcatttcacaaagcttttaaggctccagtcatggtgccatgacattgttcccctggacatcattaaggaaagtttgaagaaaggaatgagacgtttgtcttcatgccaaaaaaaatggcagtcaacccttagcatgcaatatgctttacctttgcagtgtgactgttgaagtgggatcgtgaaagtctgttacatgttgtacttaatagcaaaacaagtatatacagttgactctttaacagcaaagatttgaactgcgcaggtccagttacatgcagattgttttcaaccaaatgtggatttgcaggatatgaaacccgcatatactaaggaccgacttttcctggaggccaattccatggggcccactggggcacttgaatattcacagattttgttatatgtggggatcctggaaccaatcccccacatatgccaagggatgactgaaagagcaaattacacaggtagtgagtgagtctatgtgattcctagaattacatcctaaagcaagtttgtgatataataaaacccgagcaatgcgataaaaagttagtgtctagtgaaaagtagtttactttcagttctgacaatgagactaaaggaaaagtaaataaaggaaaagaaggactttgctcaatcagtagaaattgtgttcatctttagaaattagaaagttgaatttgacaatggctctcatctctaaatggaaactatcaaaggttttcatggatatgggaacccatgaaaggattgttcaaggtctccagacacatatcaagactttcagaggtctgatatattttaagggaagaagagatgagtgatataaccaaagtataataattttatatagctgagtgttttttttctaatggaggcattttaacaatagggtataataaagaaaagattatatggaatgcctttctgactatatctcttttctttatgatcaaattttcaaatacctgatttcaaattgcaaataatctcattaatgtgatcatagaaagctaaggtccggtgggaggatctggagtggcagtgatccaaacaagtttcttttatccccatgctatacttttgattctctttgtaagcttccttttcttccaatatgtcttcctttacgtgcttttcctttagcatcttatactgaataaaatccctgctactctaccttatatggaagcatagacttcaaggagggtgaagatctcataagatgagaaagttgtagaacaagaaaataaccacctattgagaatacttaggagataaggtgatgagattacttttatttctcactgattttccttggccacatttcattttttttttttttaagatgaaacaaaacaggatctcattatgttgcccaggctggagtgtagtggctattcacaggcatgatcatagtgcactacagccttaaactccttggctcaagtgattattctctggggttgcagatgggcttggactgtgtagaacccatcactgaactaacatttactattttgattttgtacatttttaaaaaacataagagtgaaagaatgagtcaaacgtaaatcttggaagagtttagtttatgggctgagaatggatctacagggtttctttaactttgatctacttgaagaaaattggtcttagacttgtactgggtttaaatgagtgtgtcatgcttgaagaaaatacattttgttcagtgcacaaattttaggtatatgaaagttaattcgttaaagtcctttatgaccgtcattctgattcttgataaaatcaagtgtctgctatcaccttttcctgagcacatagtgtctatcagctcaaatatcaactatggtaatatttgtgaaaagtcgacaatatcagtgagagtggcatgatgtcatgaaaagaacatggattttgtggaaaattgatttaagttgaaatctcaacttcacctcttaacaaatatacctgtaaatgatttattaaaattttgaaagccttagttttctcagttttcagttgagatttatattattaattgagctacatgaaaatttcaatatagaaacattttgacttacaaaaatgacaatttaggttaacctgtgtttagtttaacctaatatatcgcttataagatttttttttgtcaggggacaggggcagggaaagagaggaaaagattaaccaaggtgaggaagaaatgagtgtaagactctcaaaaagtgttaattcccttcatcctaacggcaagttatagtagacaaatttatgacaatgctaagacttatctatttcagaaaacatctttggaattaagaatgttttgaagttgaaatttatttataaacatttgttaatgattataaaaatttccaacagttaagagaaaataccttctagtttagagcaaagcatgcattttgaagtgatatgaaaaaatattttgccaatgacagtatatattattttcttagttagaatttcaaaaatatttaagctcacagttaattgttttccaattggctgtggtttccacattttagctcccaaattcttggcctttataaaaccttcgtcaagcagctcataaattgatatacacatgaaaaagacccattttataggagagtaacagtgaattatttccataaaaacaaaaaagttttaaaaacttttttgatatcaagtacaggatatttaattaaacatatacctcagttcataacacactatcctcatgggtctgtgccagacttccttttactttcttcttcattcattcattaatttatcaatttaatcattctccattatccaatcccactctttcagcggtccccagtccccaagccacagacagagaccagttcgtggcctgttaggaaccgggccacacagcaggaggtgagcagctggcaggcaagcaaaacttcatctgtatttacggcggctccccattgcttgtattaccacctgagctccacctgctgtcagatcagctgcagcattagattctcttaggagcatgaaccttattgtgaactgcgcaggagggatctaggttgcaagctccttatgaacatctaatgcctgatgatctgtcactgtctcctgtcaccccccagataggaccatttagtttcaggcaaacaggctcagggcaatcactgattctccattgtggtgagttgtataattatttcattatatattacaatgtaataatactagaaatgaagtgcacaataaatgtaatgcagttgaatcatcccaaaaccaccactgccccctccaccaatctggaaaaattgtcttccccaaaaccagtccctggtgccaaaaaggttgaggaccactgcattctcccccttacaatagcagtctttctaatgtgcttgatgtttatccttttttcggtgttttatgtatatgtatcttctaattcacaaaaatggcattggatcataggacttatttagtttcctaatttttctcatctgttattatatttttgaagtctatttatgtggccgtgtgcttcttttgtttcttgctaccaactgctacatggtattccattgtttgcatctaccactttttatatatccattcttccaggcatgtaaactcagattacctctaatatcctgctgcttcaaatagcatcatcatgaatataaaggatactgttgtaatataattattatatggtattttgttggatctgcctactaggttttcttttaaaaaggagcacaaataagttgttcattttgtttaaaaaatagcatttttttagttacttgttataggagttggatttagtcagattaggataaatgtgaaaataatatcaccatgtggaatgagtttacaaatattaatatatttgattttaataactagttttcagcaagaaaactaaagtatattgtgtgatgtagggaatgaatgtagtgagtattttaagtatgatttaacttctatatatctttcttatgaactgcgcataatagtaaccatttaaccaaaaaaagctacatatatatagttacagtaaaaacaacaagcctgacaaatgtaacatcaagcttgggagtactaggcaatggaataaaaaatataaaagagaacattaaaaggataggtgcaaatagtggaatggattttcttaaaagacaggtaaataaaaaagtagaaaacaactcaccctaacttcctgaactgcaaagtacagtatagtagatagcttgtaccaaccctaatgagcaatcgtaggttaggaaggttgtgagatggaatatgagtggagatgttttgttttgtacatggcaggatattaggattttctttattaaaattgtagtatgtgttaaaatactttttccaaaattgtttgctaaatgtcttaacagcacacaagaaaagcaaaccataagaaatatagtatggaaatatgatatcaccagcgaaccagaggttggataatacttaatgtttggggccagttagtagtgttaaagggtcaggaatttttgtccattgtgccctcccagtgcctcaatatttcttccctatattacttggaacccctcttatttcttagattgctatagtataatatcaattattataattttatctcttccctgttcctattctattgtattctgtcctgtcctgtcctatcccgttccatctcatcctaacctattctgttgaagcctgcgctttacgttaatatatcctcagttatcaaaagtctagaagaaaagggatcagcagcttaatacccttctgaaagattccatcctaagccattaaatattttcaaggtaatttttagaagtttatcatgcattttccagtatgaacataatgcataccattagggaataatgaaaaatgcacaaaagtagaaatggaaagtttttaaatattatcaatatttgaagacaatattattcttcaaattgtatttttaagacttgccctaccttattttcttaagaaaaataatttttcttataactgttttatatttactaattgttttcctatttattatagaaaataggggaaaattaaaaaatgttatatatatcatcactcacacataaccaccattaacattttggtgcatgtcctcagtacaagttttttatttttttaagtagcagtgtgatcattcagaatcaacagttttgtttcctactgtaaaatgtagcataaatatcacattagatttatctctgttatcacaaactccttaagcatatgttgtttatttttaatatttcactgaataaataaaacacaaaacttaaacactcccatatttctgcaaatgcagttggcttctgttatttactgacttataaactgcaatgaaaaacatcattgtgtagaataccccctctgttttcatatgtcctttggacatgttattagattttcaaagtatattaacccatttaatttcttttattgtgactttgtacggcttatttatccattgaattcttggtacttaattattaaaatatattaaatgtcaaaagaaatacctgattctgtatattaaacactgatgatacaatagaaaaaaatagaaacttccctctacatcttagaagtaaccacctgaatcgctttcatttatgtttatgtctatatatcaatgactgtacatgtagatacacatatatacatgtgcatattattcagtaatctggatggatattactatttcatttctattatgtgaggctaattaattttatctttaatgactacatagtgcaccataatgccataatgtacaccataatttattttgcatttctcaattgttggacaactttaattccttttttttttttttttttggtattatagatcatacggcagtgaatatccttgtagaaatttacttgtacaattagaaaagtgtttctgtatgtcattttactttttaaagaaattccaagatgtgatgtattggtcttactcaatattagtttttagagaaaaaaaagattaaatttgaattgcatttcctttgtctttgtaaaaatgtggcactgatgctgtaaacctttttttgtaacatttggaaactatgcagtgattgtcaattggagaaaagaggactacaaatacatcatcttatgtttgatttaatttaataggttggcgcaaaagtaattgtggtttttgccatggaaagtaaaaaccgcaattaattttgcaccaaactaaacgttattttcccaacaactgcactagtgtggtccactgcatgttggccaattgaactctgtgaagagtttgtcagaagaatctaatgctttaacatgtatatatcaggaaatttaggaaaatagtctgtaccaaattatccattcatttagtccctcttaactgagtacctactgtgttaggcattttggctctttctttgcatacagagttctttctctttgaattgatagcttattttggaggcagtgttttgttttttttccccaaggaaagactggaagagagtcgacttcattcaaaagttgaaagtcatagttaaaagacatgccgagttagctaagattgctagtattttgaggacagagatagaatttaaaaacaattttatagattcaattagtaaaagttaataagaaataggattgagttcaggaggagtaaaatagacaatatgtttaagtaggctatgcttaggagacatgagaaaaagatctttatattgaatatcctatattcactatatgagttttaatatatatcattatggatagtctgattaaaattccaataaatgaagaggtatcattgtcatgtgcgttttctctcatttttttttttgtttattcaggccaccagtatatctttttggcttctaattttcagaggaatgttgaaaaattaaaaatggtttaaagataaagaggaatgaggcaacattttggaatgattgtttttgatgaggagtagatgagaggtaactaaacgctcagtaattgtgatcggatgtgctgaacccatgatgtaggagacacaaggcctgtttcagttatctagtcaaccatgctctctgcaaaacactttcaacttctccatgccttctcctgtgcacagataatttctgtagagggaggaaaatgtaagagtgacataaaatcaaatgctctgtaagttttgaaaccttgttgagacttagaaagatgtctagaataagggatgggtataaatattgataggaatttaatagatgaaccaaaaaatatttccacttcaataatgtttttcagccaaagaggtcaaacctttttcacttgatacatttctataaggaaaagtgaaggcagtgtttactgttgttcaaattcttcaattctaggttctggagacaagtggccttggtagaggtcacaggtattaattgtgattaaaatttcataatcatttacacctggtgaactgttcactagacaatattgtctttagaaacccctggctgtgttcatatgcaactctgaatgccatttatgttgaagtttaactttgccagacaggcacagagtctagaagtgaatgttttctgccctctgtgcttttggcactggaaagacaaggtagacaaaattgggacaaaaatatgttataatactgctttcttctctctctgtaatagctatgtgtccttctgacttttaatagcttttctagggaaaaaccacattcccactgaaaatggaagaatgtcatttttagaaagcgtagataaaaaaatgatgacataaaacaaatagaaaagatttgagttaagcataaggaaatctgaatataaagtcattatgaactgtatatttttggtagcccctttagttttatgaaaaaaaaattacaccttttttttctttagaattgatagcttcttttggagacagtattaaggaaaaaaaagcagattatagatgagaagataggtcaacttgagtcaaaaattacatcatagttaaaagtctccagggaagctagttaacagaaatgagctgggatcatttggaatgaattatggtttattatggcattaaggtacatacatgagcttttggttataccccaagaacactgaattggtagtttattttcagaattttttttaaaagaaatgattgcttcaattattgttcatcattttctggttactcatgacatgttcttcatcattgttttcatatgaaaccttatcaaaataaccttatcaaaacagttaggtaataaaggccaggtgcagtagctcatgcctgtaaacccagaacttagggaggccaaggtgggaagatcacttgaggccagaagttcaaggccagcctcaccaactggtgaaaccctgtttctgctaaaaacacaagaaattagcagggtgtggtgctatgcacctgtaatccaagttactcagtaggctgaggcagaagaatagcttgaacccaggaggcggaggttgcagtgagctgagattgcaccattgcactccagtctgggtgacagagagagactgtctcaaaaacccaaacaaacaaacaaacaaacaaacaaaaacaatcaaaaaagttaggtaatcagctttttaatcagtccttcactgaaatgtcattttttattcttaagtgcagtcttgttcccatggaatgcctactatattcaaaatttttattcccattataatttattaatgatatgaacctagtgatattaattaggactacagttttgacttataggcataggaaaaataaattttttccaattttctgccatagacctttttgattactatatagaccataaaaatatgcttaccatagctttgaaaaattgtacagcttactttatgtggtttctctttttgttcatgtatctgtctcgtgactattttttgttgactttcgttgctcagaacatattttccccaaagagtacttattagaaacaattttatttattaataaccatgcatttttgaggtcctcaaaggtaagaggcagtttgggcttttccacttgcctgtgcagccccttgctagctttatatgggagacaaggagataaatacgtaaaccattataatagaaagaattaagtgctctaggagagatatggtgaaaggcaaaaaggaaacacggagaaagatgctccagatttgtctaaatatatgtaaaagggaaatttggagagttataagtgagggtggagatagggatatgggccctagcaagcccttacagagaaagtgacactcggacactttcttcactttctttgtgactgaaagattaataaagagtccatctggtagttatcctgggggttggaacaggtacaatgccaatacaaatagaagggatagcagcagtctgagctgtggatctgtagtgtcaactgagataggtagtaacaacttgggttagctaatcttcataatgcatctgggagctaaactgaggcatataatataaaagtatatgtagccaagtagcctaatggtatcatcagttaggcctgtttactgacttggaatataagttgggaccaaaaaaaaggaggttggactagatcatctacgcagtctcatagaaaagctatagtggctttgaaacttttctttaattgggtgctgttccagaggcaatcccagcctctgaagtggtggaatagagagagagtggagggtggaggcagagctgctgagcctgagcaagaggatggaaagtgtatgtcctgagttctgattccagatcttaactggatttcctgggtaatcacttttggtattctctttttctaaaataagggcattgaaggatcatctcttagcctcattcattcattcattcattcatccaccatatatttatagaacacatagttgcctagaactttctttgaattctttagatcatatgagtgaaataaagctcagtttatacaactacaatgagaatgtcactttccaaagctgtggctggaaaggcagcctggagatttgtaggaagccatgccataagttcatttaaattctgaaactagtttaaatgtgtggatgacaagggacactaggatgatgataataacttctgttgacttcttactatatgtcaagcactgcattaaatactatatatgctcacttaatatatacaataaccctttggggtaggtatcttattattattattattattattattttcattttgcagatgaggaaaatgagactgagataaagtcacatagttacctaagaccacacagctagttaaggggcttcatattcaggtttatgtgacttcaaattgtcctctaaatcaatgagtgctgatcctggctcagaactccacccgagacctaaggaataacaacttcagaagtttggtagtagaaagtggtttattttaaaatagcccatcaggtaataactatgtacagtccaatatgagaagcctttgtcaagatttacataaaatgagaggaaaatttgttgattgggtaacagtataagcaactgaaagagtaagaaagtgtaaaaatacggaaagagcattaggcaaggtgtccgaatttgcaactctgttctggggagtgatgcattgcaagggaagtgacacagaccatgaagaggagacttgggttcccattcttgcagctttatgaactagcagtgtaaacagggcaaaaagaaggttgaactggatggtttgtaaggcgccatgaaagaactacagattttttattctaaagcactaaagaattaggctttgtatgggcatcatttggtttgattaaaattttccttgggatagaagagtcaataaaattgatcacaatgagcacaaatttacatatttttagacaaacaccaatgccaaatcagaattttaaaatattttatcactttaagttttcgttatttttaattttgttttcctaattgttgactcaccaagaagcacccagaaaaatgaccaattattcaaactaacctctctggctttttcaactccctttgaacaatagtttagtgtacatatttacatgtagaatatcatcttatgttcccttaatttgttgagaaaatttccagttgagaacaaaatgttcatttgaaagttaatttgccaaaacaggtagtttgtaagtcctctctagagtcagctatttcataggatttggtacattttaatagctttgccaaaaatttggatgaagatgtgaaaaacataaatgtaaagctttcaggccttgtgtggtggctcactcctgtaatactagcactttgggaggctgaggctggaggatcacttgaggccaggagtttaagatcagcctaggcaaaatagacaaaaataaaagtaattagacaggtgtggtagcatgcacctgtagtcccagctactctagaggctgaggtgggagaatcagctaagcccaggagctccaggctgcagtgagctgtgattacaccattggactccagcctgagtgacagaatgagactgtctctaaaaataaacaaataaatgaaaatcaaaatttctagctgaggcaaagatgagagggaaaaatataagaatacagaattcacaaccaatataatagaataggttaattcttgcatttatgtaccttctctcacccgctcccatttttttcttttgagtataggataaagggatcattgtttaataggaaattcatgtgaagaaaacctatatgttggaaactcaagatgagcctttatgtgacataatttccataaaagataacacaatcttaaaattagcagatagcatccgtagtaacagagacgatagtcttcagcactgctctgggcaatgaccttttgtcaagaatgtactgaatattggtgcacaaagatgatggagtcttaaaattatatcaacaattgtagaagcaactaattgtatttagcatggagaaagcaagattgatttaggaaattataccacttttatcttcagtttttgaatgtctgtcttaggaaaattattatgcagagtagctctgtgggtggaagttacagagacacagatttcatcctagtgtaagaaaacaaaatagaacagtggaacagcctgttatgtggaagaattcaaacagagtgtaggttacctttggttggggactgtcagagaaggggtttagacagtgggtgggaggtacagtatgagctaggccctttcagatttccagttttagaattatatgttttagtatttagcaaaataaatttactgataagtaaaatatttagtcacaacagaatccctcctatatgtaacacacataattaacttgaaatgtagtccttgtcactaacaaaattttactgatgcgatgattaactatacaaagtaatgtaattgccaaaattacttccttaacatctgttgtccacacttcattgagaataatcatcgccaaatactaatctcttcatgccacttcctggcttaaaacacaatcattctgtgctatggactgaatatttgtgtccccccaaaattcatatgttgaaatcctcacccttaaggcaatagtattgggaagtggagcctttgggtgacttggtgattaggtgatgaaggtaaagccctcatgactggcattagtgcctttatgaaagaggcttcagagcactagttagtgaccatgtgaggatgctagcagaaggcactgtctatgaggaagtgggccctaaccagacactgaatctgccttgaccttgaacttgtagactccggaatggagagaaataaatgtttgttgtttataagccacacagtttatggtattttcttaaagcatccagagcagactgagagagatgctctgcactaataaaataaaataaaaagataaagacaaattttttttttttttttttttttttttttgtgacgagtttggctctgtcgcccaggctggagtgcaatggtgcgatctggcctcactgcaagctccacctcccgggttcacaccattctcctgcctcagcctccctagtagctgggactacaggcgcccgccactaggcccagctaatttttttgtatttttttagtagagatggggtttcactgtgttagccagcatggtctcgatctcctgatctcgtgatccgcctgccttggcctcccaaagtgctgggattacaggtgtgagccaccgtgcccggccgataaagacattcttaatgtaacctacaaagtccagcgagctccccccaattagcttctccagctttatgttccattacccttcatttccaaatgaaacatattggcctactatttatttattacatatacaccatgttttcatttgctacacatcatttctcatgctgcttttttccctgcatggatgtccctcttatttctagctgacttctagttttattcttcagatctcagtttcctttatacttttcattaatcaaggaaggcttgctgatcttcccatttagatctgatttcctgttacatgtattcatactctgtttctcatttatcactgttacaaattgtatttgcttatcaagttatttgattaatgtatttcctctactaaaacataagcagcctaagggaaagggaattttatgtttttagttcactattgaactcctagtgtcccaaaatatgtgccgattacaataaatatgtgttcgattaataatataagtggaacagatagcacttactttaaaagtacagaccaatgtttagtgaaaggatgtgatccagtgaccctatggcaataagttaactctatatactgcctgcattttttagactgtgtttacttttcacaaaagccctaacagctaggattattatgttatatttgttttataggtaaggaaattgtatccctctcaattaactatttcaaaattaatatttattaagtaggatatttaagataagaaactgtttgagattttaagaaaataaccatgtgcttggtatacctagatattatgttcttcaataacttactttaaatggcatttaaaatatttttctataggattgtcttggttcaggctggtataactaaatatcatagactaggcagcttaaacaacaaacatttttctgttgcttgggaagtgcaagactacagtgtcaatagatttagggtttgatgagggccctcttccttgttgacagatggctgcctttttgctgtatcctaacctggtgagagaaggagaggaggtattctggtgtcctcctcttcttataaaggcattaatccttttgctgtgcagaagttctttagtttaatcagatcccatcagagtgaacaggcaacctacagaatgggagaaaatttttgcagtctatccatctgacaaagggctaatatccagaatctacaaagaacttaaacaaatttacaagaaaaaaaaaaccccatcataaagtgagcaaaggatatgaacagacacttcttaaaagaagacatttatgcagccaacagacacatgaaaaaatgctcatcattgctggtcatcacagaaatgcaaatcaaaaccacaatgagataccatctcacaccagttagaatggcaatcattaaaaagtcaggaaacaacagatgctggagaggatgtggagaaatagaatgcttttagactgttggtgagagtgtaaattagttcaaccattgtggaagacagtgtggcaattcctcaaggatctagaatagaaataccatttgacccagcaatcacattactaggcatatacccaaagggttataaatcattctataaagacacatgcacatgtatgtttattgcagcagtgttaacaatagcaaagacttggaatcaacccaaatgcccatcaatgatagactgggtaaagaaaatatggcacaaatacagcatggaatactatgcagccataaaaaagggtgagttcatgtcctttgcagggacatggatgacgctggaaaccatcattcacagcaaactaacacaacagcagaaaaccaaacactgcatgttatcactcatagatgggagttgaacaatgagaacacatggacataggagggcacacaaactggggcttgttgggtggtggggggctaggggagggatagcattaggagaaatacctaatgtagttgatgggttcatgggtgcagcaaaccaccatggtacgtgtatacctatgtaaaaaacctacacgttctgcacatgtagcccagaacttaaagtataacaaaaatgttttttaaaaataaaggcactaatcctatcatggggactccattctcatgacttcatctacatctaattttgtatcaaaggccttaactccaaataccatcacattggtgactagggcttcaacaaatgaattttggagagaaacggcatttagttcataacaaaaactaatctttgttttgtttatacttcctcattttaaatctatttgtagttttaaaaattacatatggaatcctcagttgattatgtatcttagataccttgacaggtgggacttgtaacttgaaaataacacttccatctagtgacaactaacctgattaaattaaaaaactctggagtagctgggaagggtaaaacaaatcattcacatagaatggactggacacataacttagagcagtcattttttaaaaataaacacctgaagtaactgatgcttgtgaaggttatggattaataatgatcaaacaaaacaatctgtttagctaatagaatattgctcatgtagtaactagataaaatgttttcttataatcttgccacttaaaaatgggtccgtctccattttcctcactccactgcttctgaatgagaaccttttgtactctgaaaacctagtaaaaagttttcttcttagtttaaaaaactaactatattcaggaacaaacatgtatgagaaagtgggttcttggtaaaatttccagttgggttttgcagaatcgtaaagaagttgatgttaaaataagctctatttatcccaaggggacacttaaatccactttgaattaaattactgtgggatttaatataaacacaataataaaacacttccagacatgcaatacatagttagacaatgaagatatataaaaattttctttaaagcattgaatctcaaaggaaatatggatgatttatttgtatctcttaattcctgaatttatgttatagattttaggtgatatattttaaattaactattcagctacattaaaactacaaatacaattgtcatatacaatcctttgagctaaaatgttcttatcatatgcaaatgccagatcaaaagagataattattctatttctctggaagcctatataaacaagaaaaacctatcactctcaaatgataattatttcactgattgagatagaaaatcatgtttaatcttttttagatagtccagaaggtattatatctatttgtccacttactggtatatccattaaactgtatccctaaggtgttccaacttaagatgtagaaataacctaactggacatattaattgctttttatatcagtcaatgaaaattactgctttcctgaaaacactatttattatcctgtctccctttcaggaactatatttcatatgctgacaataaacacaaagttgacattttgccaacagttaagttggaaatatcaagcacgtgaacaaattcaagataagaaaagcatctgtcttacacatattcttagtcagtgtcattaaaatagagttgttttgtggcctacttcaggaaaaatatacagatatgaccccatctcttgttatatttgtatacactattcatataaaaagtgtggattgtaccagacaacaacagatgacaagttatgattcaaacttgttgccaaaaaatattgcatcaataccaaagggaactgattctttgaaaattatgttgtgtcatgtgattgtaattagcttgtatgaagcacagctgatctaggatgtagaattcagtggtaatccagagaatagtgttcctattattattaataggaattattgctatatgacaggcattcaattaaacgatttacatacataattatttttgtttttattaaatggacagaatctgattactaatattcctcagttcctatcccaatttgttaatttaaacatgatcctcctttatttattttatacaaattacttatgatataatgaatatccatacatacacctagaattagaacattgtgagtaatttacatctatgtatttggttatcttatcatatatctatctttttcttctctcttcctgcaaaagattaccactattgtgaattttgagtttctcctttctttaacattgaaaaaaatagttttattttgcctgtatatttaatatattacttgttttgattcatttctaactttttatgtcttgagaaatccatacctacgctaatgtccaaaagattaatatattatgttctattaaaagttttgaattttgattttgatatttaagttcttaactattcaggaactaatgttttggggtggtttgaaacaaggatgttacgtgattttgtttgcatatgataaccaatgtttttcttcatcgaatagactcttcttttcccattaatctgacatgccatctatatatgtataattgatacttatatagttgtttatgggtctttgttttgctccgttggtcagtttatctatctatacacaagaaacacattctgaattactgtaactttatagtaagttctattatgtgaaggccaaattatttctccttttcttttagtgttttactttgtttctgctgttttgcatttctgcatacatttgaaagtcggcttgtcaagttttatgaagaaaacctattggagtttgactggagttacatcgagtttgtaaatcaattttgagagattgacatctttacaatattaaatctccctacatgaaacatggtgtattaattatctacttagcccttctcttacgttcctttagttccttgtttttacatgtgtcttgtggtttgtttttttgttaagttttttactagacaatttacattttttattacttttataaaataaaatctttaaaatatgtttttaaaaatatctgtcgccattttatagtaatgcagttagctagctttctttcatgcttcttaccctcccttgcttcctttcttccttttttttttcttctttcttcccaaaagtagcagaataaaacaaaagtttactaaggattgcatttattgaatagaaaacattttagagtcctgttacaagtagcttgtggctgaatttcctcacatagtggtattatgttctctcttggcagatgggtaacgcaaacattagaaaattcaaataatttttccataacttgaaagaggtaatagtgggattttactggtcaattttactttaagacctgtgacttataagatgttctgtaatgagattttgttcccctcattccactttcttctgctgcataatgttaatattggatttaaatattttcttctcttatttatttatttatttatttatttatttatttatttattttttgagatggagtcttgctcttttgcccaggtcggagtgcagtggcgcgatctcggctcactgcaagctctgccttccgggttcatgccattgtcttgcctcagcctcccgagtagctgggactacgtgtgcccatcaccacacccggtcaatttttttgtatttttagtagagacggagtttcactgtcttagccaggatggtctcgatctcctgacctcatgatccgccagccttagcctcccaaagtgctgggattacaggcgtaacccaccgcacctggccttatttatttattttttaattaatttatttttttgtttcatattcttttttttaattatactttaagttttagggtacatgtacacaacgtgcaggtttgttacatatgtgtacatgtgccatgttggtgtgctgcacccattaactcgtcatttaacattaggtatatctcctaatgctatccctcccggctccccccaccccacaacaggccccggattgtgatgttccccttcctgtgtccatgtgttctcattgttcaattcccacctatgagtgagaacatgcggtgtttggttttttgtccttgcaacagtttgctgagaatgatgatttccaatttcatccatgtccctacaaaggacatgaactcatcatcttttatggctgcatagtattccgtggtgtatatgtgccacattttcttaatccagtctatcattgttggacatttgggttggttccaagtctttgctattgtggatagtggcacaataaacatacgtgtgcatgtgtctttacagcagcatgattcataatcctctgggtatatacccagtaatgggattgctgggtcaaatggtatttctagttctagatccctgaggaatcaccacactgacttccacaatggttgaactagtttacagtcccaccaacagtgtaaaagtgttcctgtttctccacatcctctccagcacctgttgtttcctgactttttaatgatcaccattctaactggtgtgagatggtatctcattgtggttttgatttgcatttctctgatggccagtgatgatgaacattttttcatgtgtcttttggctgcataaatgtcttcttttgagaagtgtctgttcatatccttcgcccactttttgatggggttgtttttttcttgtaaatttgtttgagttcatcgtagattctggatattagccctttgtcagataggtagaatgcaaaaattttctcccattccgtaggttgcctgttcactctgatggtagtttcttttgctgtgcagaagctctttagtttaattagatcccatttgtcaattgtggcttttgttgccattgcttttggtgttttagacatgaagtccttgctcatgtgtatgtcctgaatggtattgcctaggttttcttctagggtttttttgattttaggtctgacatttaagtctttaatccatcttgaattaatttttgtataaggtgtaaggaagggatccagtttcagctttctacatatggctagctagttttcccaacaccatttattaaataggcaatcctttccccatttcttgtttttgtcaggtttgtcaaagatcagatggttgtagatgtgtggtattatttctgagggctctgttctgttccattggtctatatctctgttttggtagcagtaccgtgctgttttggttactgtagccttgtagtatagtttgaagtcaagtagtgtgatgcctccagctttgttcttttggcttaggattgacttggaattgtgggctcttttttggttccatatgaactttaaagtagtttttttccaattctgtgaagaaagtcattggtaacttgatggggatggcagtgaatctgtaaattaccttgggcagtatggccattttcacgatattgattcttcctacccatgagcatggaatgttcttccatttgtttgtatcctcttttatttcattgagcagtggtttgtagttctccttgaagaggtccttcacatcccttgtaagttggattcctaggtattttattctctttgaagcaattgtgaatgggagttcactcatgatttggctctctgtttgtcgttattggtgtataagaatgcttgtcatttttacacattgattttgtatcctgagttttttttaaagttttattttaggatcagtggtacatgtgcaggtttactatagggataaattgtgtttcatggggatttagtgtacagattatttttttcacccaagtaataagcatagtaccacatagtttgttgaatgtcacgctcctcccaccctctaccctcaagtagacccctgtgtctgttgttccattctttacgttcctgtttactcagtgtttagctctcaatttttaagtgagaacatgttctcggtatttggttttctgttttaggataatcatctccaggccattcatatttcttgcaaaggacatgatcttgtttctttttatggctgtgcagtattccatggtatatgtatacaccatattttctttttccagtctgtcattaatgagcatttaggttgattccatgtctttgctcttgtgaatagtgctgtgatgaatgtatgtgtgcatgtgtctttatggtagaatgatttatatccctttgggtatatattcaatcatgggattgctggatcaaatgaaagtttggttttaatttcgttgagaaattgcaaaactattttccacaggggctgatctaattcacattcccatgaacagcatgtaagtgttcccttttctctgcaaccttcccggaatctgttattttttaactttttaattatagccattctgactggtgtgagatggtatttcattgtggttttgatttgcatttctctaataattagtgatgttgaatattgttttcatatgcttgttggccagctgtatgtcttctttggaaaagtgtcttttgatgttcttaccccactttttaatgagattgtttgttttttgcttgttaatttgtttaagtttctcacagaatctgtgtactaggtctttgtcatatgcatggttttcaaatattttcatccattctgtaggttgtctgttgtagtttcttttgttgtacagaagctacttagtttaattagatcttatttgtccatttttggttttgttttaattgcttttgttgtcttcatcatgaaatctttgccaaggtctatgtcctgaatggtatttttaccaggttatcttccaggctttttgtagttttaggttttacattaagtctttcattcatcttgaattaatttttatattgctttatatttaagtctttcattcatcttgagttgatttttatattgctttaaggaaggggtccagattaaatcttttgcaaatggctagccagttttcctagcaccatttatattgttattgtagtcttgtagtataattcgaagtcaggtaatgtgaggcctccagctttgttctttttgcttggtatagctttggctatttgggttcttttttggttccatatgaatttaaaatagttttttttctaattctgtgatgactggcattggtagtttgataggaatggtattgaatctgtaaattgctttggccagtatggccattttaactataatgattcttcccatttatgaacatggaatttttttttcatttgtttgtgttatttctgatttctttcagcagtgttttgtaattctcttacagaggtgttttatttacctggttatttgtatttctaggtattttattattgttgtggatattgtgaatgggattatgatctggatttggctctcagcttgaacactgttggtgggctgatgttcctttagtctttgaagttactgttctttggatggagttttttacaattttattttctttgatgcctttggaagtttggttgtggtttgaggtaggttcagtagactgactttatttctggaaggttttagggggccaaggatcagcttagcactcctggactgcctgttaactctggatggctgtactaggccctcagctgcagtctctggccctttgaggttaggaatctgattcactcggggggctgaggtgtcccagtctactggccacaactctacaaagctggtgctggcagggtttactcctgttggcttgggtggcacactggtgggagtgagcctgaagtggtcctgtgtatgctcatgcctatggcagtggcagtgtggctggtgcagggcggtggcagaggcagagttgccagcgtccatgtacacatttgtgctgttggtggaagggtaacagggcactcctgcatcagcaagggtttggacagttagctctgtttgcatcatctgtggtgacacagtgggatgcattcacacacacgtactggctgggtaagggaggtgaggtctgcccacatggggagagggagactgtagtgggtcaaggctgcaggttggctagtgtgcatcgtcaggggctggtctactggagctcttcaacaaacagacacagtcttccagtgaaggagctatgatgataacccctgggaagcaacttggttggccatcagaggctgtgcttcaagcaggtacatatagccaggctgtacccaggagaggccagcagacagaggatgtgcaatttggactggtcccatcccatttgcaacaccaccatgttctgtccaggtccaacagtctctcaaaggctgacgtcacttagaaggccatggagagtctttggggatgggcaccctagccatactccactgcagctgttcctgtcccaaaccctgtgggctctgcacaggctggaatcctgtttcttccatctctctgccaactctctgccagctcaagtgtccgtgggagtcatgggctgtcttgttgccaggatttttggggattcctggtgaggacagagcactcctcacctgtttagctcattccgcaggagttgctggggtccaggagcgagccccagtgctcagcagccccctacagggctcccagcttcctcctcaagttcagcccactgtctgtgtcctaactgcatccactctcaatgctttcctgctgaagatctgctcagagtttgctagtcttccccatgtccctgtctctcagtgtgagatgttcctcctggctgtatctagtcggccatcttgggtcttgtcctactttcttttcagactaaatctttagtcttttcaaaatctgttaatagaaatatttgtgcatttatatttgtcaaaatatatgtattctaaatgtacttattatttatttctattcatccattcatttattcacacaagacttctttttgaagcttgcttagatttaccttcttaaacaattttaatttttaattattatagtaattgtatatatgtataaaatacacatgatattttgatacaaacatgcaatatgtcataagagtagctgggatatctatcacctcaaccatttatcatttctttatgttggaaaaattgtaattccactcttttagttattttggaatatacagtaaattattgttaactatagttgccttattgtgctatcaaacaatagatattattccttttaatgggtactgtgttcatgtacctgttaaccattgcctcttcatctccccacttcccactactcttctcagcctattctctgtctccatgagttcaatttcttttttttagctcccatatgtgtattcactcaagatttattgattaccaaatttgatggatagagttgcctacagattgtgggagtaagaataatgtaactaggaattttcttgaagtgcctgctttttgtttcatatatatatatatatatatatatatgacttcatcttcttgataacagtggggagttttcagtgaccacttcataatattttccatgatactgcaagctgtgcaatttaaagttattggtggacatacaagctttgtgaataaaataaccacaaagattgtaaatatttgaacaaacttgagagttgtaaccaaataaaatgcttatcagagcatggtacctgtgtttaaaaattcagctcaattcaacaaagatttactgaaaactaccactgtgttagggctgaggatacatagctgtaaaaaatggatcctgcttttgaaaaacttactacctgggtgcaggaaaagagtagaaaggaggagtaagccagatcctagagttgagaggaagttataaggagaaatgaggtacctttggggcttctgcttctccatggaatgtccttgtgataatatataagaatcaaggtaatgcatagaaagtcagaaaagtttgaggtattatgacacaaacacattaattcatataccaactaaagaggaaatggtgctggctaggactataggggtaactcatgagtaagtaataaactaaagtagtcatgcttgatggaagatgaaacgcaagacctgtgtttaactaacatactttactggcaactaagcataatgtatatggcctataggagctattggagtaggcttttctcatgtctctcaatttaatatttatccttccgtatccttcagtacattttttgccttagttttaaccctgagatgaaaagagtcatagattccagggtacagaattccttttcaactagtttgacttttgacaaggtaaacagcttctaagatctttatacaagtcatctgtaaattgagtataatagttcttactttacaaggtttttgaaaatattttcagtgattcattaaaaacgcttagcctggcgactgttctgtattggatgataaagagatggtaaacctgttagttgtaccttactatgtcagctttctgtagatgagatctttgttgttcctgctttgctttttatttatgcccagactatttacttttgtatttttaatataaaaatgctatttttaaagctacatttggccagtaagtttggaaatatgcaattacactttcttattataatttaatggttgtcattgtttcataacttgtaaacagtacagttggctaaatagtcttaggtagtggtgttcaacccaggtggcatattagaatcatctggaaagctttcaaaaatgccaatgttcagacactacccaaagtcattgaattcaggatttcttgtggacctaattattattattttgtaacagctcttcatctccaacatggcaataataacatctactcagcttgtcagagtagatctgatgattacattaaaaatatattcaaaagtgattgataaacagataattaaaataaaaatgtagggtaatattaaaacattttagaaatatttaccctggtcttgaggggtttaacatttacttagagaaaaaggttaaaacataaaaaattcaaggtaacatgtcacacactaaatggaagtaacagaataattatgctaggaatcccatcctaatcacactgtgtaggcaatccttaatgtatatgaggctgtgaccttgtctagtacttctcaaatatttatacctgggctttctttaatgataaaagaacaagaacaataacctttttggggctggagagggttactaggagggaagtcttatctagggtggttgtctaaaaccacttacctcaaatgtttgttcattcatcaagtcattcaacaaaatgtttattacctaatatgtgccttctggacattttctttttaaaggcaatttagcagcatgataaagtgggggttaatagtataaatgctggagccagaatatctgggtttgaattctggctccacaactttctgattatcttatgttgggtaaattcttaacttcactgtgactcaatattctttattttttaagaaggaagacaatatcgttaattacttcctagggttgcagaaagaggtttaatgtattaataagtgtaaattgatccaaactatgtgtggctaatagtaagagataggtgtgcttttgctaacatctctgcatttttattccgttatgttcttcatttgttttagtatgaacataatgttttcagtgtgaacatatgaagataatgctttaagttagctatcaccaaatgaaaatggttctcaaaagaatggatatatcctcctcctaagacagagtcaaatatatgaatctcagtttttcaaggcactatcttatttaagattggtcattttcaacaacatggattatctagaggatgttatgctaagtgaaataagccaggcacagaaagacaaatactgtatgatctcacttacattttgaatctaaaagagttgaaatcatagaagtagagagtagaatgctgctggttaccagagcatggggatgggagtggacagagtgtacaaagtttcggttagaagaaataggcctagtaataggcctggaaataggcctgtttttgcacaacagggtgactatagttaataatagtgtgtattgtatttttcaaaatagctaagagtgtattttaattttaattttttattttttgagacagagtctcgccctttcacccaggctgtactccagtggcatgaacatgactcactgcagcctcaagctcctgggttcaagcaattctcctgtgccagtcttcagagtaactggaactgcgggtgcattacaccatgcctgactaaacgtggattttaaatattctcaccacatggcatgcatctgtagtcctagctactcagaaggctgaggcaggaggatagcttgaacctaggaggaaggggctgcagtgagccctgatggtaccactgcactcagcctgggagaaaaagtgagaccctgcctcaaaaaaattaaaaaataaatataaataaatatatttaccacaaagaaatgataagtgttttgggggatggatatgtaaaatagcttgatttggtcatttcatgatgcatacatgtattaaaacatcatattgtacccatacatatatacaattattatttgtcaattaaaaataaaataaaaattttaaaaaaacattagaaaggaggttagagacataatcagggaagtacagaaagcaatgaatgcttgtataccagtgggttctctcctagtttccgatcagggaagaagtctagaagagtcgtgcttactatgtgaccagaaagatgagtagagttagtgataagcagagcttgcagaaaagctgtggtgtgtaaatgggtgggttgtgtggagactgagagtgttccagagagagagaacacatgagaaaaatgtcatttaaaactgtgaccttatcagtgaataaagggtccaacaccacataaatgtggaggtgcagtatatacagaaactcttaaggctcttaacagccagaacaatggggtaggggcagaacaagaaatggagtttctttggaaacagtgttttcaggtgattgtaacattagcattaatgagaggagtactaagttttgtggcagtgcagaacagaaagaagtcgttcaaagggggttttagtgagaggaaaagggaagactattcaaggcttttgaaggagctggtatttggcatgattcttaaaagagcaatagggtgagacctctagcttctagagccaggacagggctttactactgtccttaactgtgtgctgaccttgccttatttgttcagctaggattgtgtctaagcagagcctcagcatctgttcttaacctcaactgcagccttatccttttacccatgtgccgaacactcttggcttacctccgaggatcacagaaggtaagaaaaaacagtcctactttcaaattccagcataaaaatcaagtgtaacagtcgcatgttagtttgtttacttttcatagtctgacttttgactggagtgatttcttgtaagatgatggtaaaagacatgtcacctgccaagatgatctgtgagttattctgcaataccagataagggcagaggataatagtaatattattaacagggatttccagcactatgcttagtgtttcacatacatgctggacaattcttacagggattctacaatcaggtattgttagtttcatttcacacacaagaaacctcaggcatagaggctttgagtaacttcgagactagggaatgacagagctaaggtcaatcctaatttgagttctttccattatgtcttgtctcattgagattctgtattttcacttagctaaatccaggtgagcaaactagagtcctttagattctgagcaatacatgaaatgattgctggtgttggcaacaacttatctctgcttaacacatatactcattttgaagtgtgtaataggcttgagaaacatgtctttttttattatactttaagttctagggtacatgtgcacaacatgcaggcttgttacatatgtatacatgtgccatgttggtgtgctgtacccattaactcgtcatttaacattaggtatatctcctaatgctatccctcccccctccccccaccccacaacaggccctggtgtgtgatgttccccatcctgtgtccaagtgttctcattgttcatttcccacctatgagtgaggacatgtggtgtttggttttctgtccttgtgatagtttgctaagaatgatggtttccagcttcatccatgtccctacaaaggacatgaactcatcctttttatggctgcatagtattccacatatatgtgccacattttcttaatccagtctatcattgttggacatttgggttggttccaagtctttactattgtgaatagtgccacaataaacatacgtgtgcagagaaatatgtcttgattaaatagtgatgtcagggggaggggggagggatggcattaggagatatacctaatgctaaatgacgagttaacgggtgcagcacaccagcatggcacatgtatacatatgtaactaacctgcacattgtgcacatgtaccctaaaacttaaagtataataataataataataaatagtgatgtcatgtattatatgcagtgttgtaaaatgaagtatgtaagaaaacaaaaacagtcattctgctaatcaacaaaaattcttttttgtctttgactaattttgtgtatatgtgtgactgtgtgtgtgcgtgttgattcttcttccctaagattcactaagcaaagcaccgctggatagatattgatattttaaaaggagttgttaacttgagatcactttgatgttctatgaatttaatgtgtgcagatttactctaggaaaacttctcaaccctttctacataattatatttagaaactctttccttttaatgcagtaatctgtgaaaataactctctctaggttgcctaccatttaaactgctaggttttgatccctgtggttggctattggtttggcttggagaaagagaagataagtggcagggaataaaaagttcccacctaagtctctcagtatttaatcattcttaaagatttgccccgagtgtgaaacagtgattcagaggtgcttgacattttattttgttataagatcaaacaggcatttcaaactatagatgagattgcttcattttaaaataatcttattttttgactgtaaaaggaaatcatatatattttaaaacttaaacattccagaaatatgcaaaatgatcagagaaagtttaccctaatcttattctgccagaacaaccactgatgacaatttgtggtaagtgcctgcagatacgttaacatctaatgccattagtgttgatcaatataagatcacagtgcagtttttttgtaactttttttttaacctaacaatgtgtcttgaacatctttctatatcaataatatggacttctcacatatattttttaatggtttaggtgtcccattaactagatagatcataattcatctcaccaatttttgattaataggcttccgccatattttaaaaattttgacataatgaacaatgctatactgaaaaacttttatcacatttgttgcattatttttaccatattaaatgatttttgtttaggttccaagcaggagaaccaggagattgttggataaaagcagaacattccatattacctgtggtgttactatctgtattttctcaggtgagaaagccacaagatattaaataatttgttagaattacacatttaaatgtaaacattccagacatacacagaatgatcagagaaagttttccctaatcttattcttccagaacaaccactgatgacaatttggggtaattgcctgcagatatattaacatataatgtcattaatggtgaacaatgtaagattgtcgtgtggtttgtgttttaaaccacacgtaaaattacacatggaaaatgtgtgattttattgttctgtacattatctgctgtcagcaacttaggattttcttattaaatagcttagtagttcttttccatgtttttgaaaagggttgtctacagggaattacagaaaatggatgtgtcttgtgatttttacattatgatatccaaaagttggcccccaagctgataatgactatttcctgaaagtaagtaatttcattccagtaagaaatactggaagaaacagactaaaagttttcaagctctgaaagtgatgatgtgatatgagtttaaatgcatgaacattttattttttatttttttgaaacagggcctggcactgttgcccaggctggagtacagcggtacaatcttggctaactgcaacctctacttcccaggcttaagccatcctcccacctcagcctcccaagtagctgggactacaggcatgtgccaccatgcctggctagtttttgtatttttttgtagagacgggctttcaccatgttgcccaggctgatctcgaacttctgagctcaagcaatttgcttgcctcagcctcccaaagctctgtgattataggcgggtgccactgtacctggccaaatgaatgaaaattacaatgtgaaatactcattagtagattaggattccatcccgaattatatgtgatcaatatttctttgatattaatatttggtagaaaaaccaatgtcaaaatttctgaagctttatcttgctcttttccaaattaagaaataaagcaatgatctttgtgctattataagcctttttaaaatacattttgatcctgagcttttagatgatacttttcaaatttttggaacagaaagtaagaaacatagtgatgaaggacatggattccgaggagtccatgcgtaggttctatcctcagttgcccttctgttttaatgtgtgatgttacctctctgatcctcaatttgctgttgttgttgttgttgtttttaactgtaaaatggattgacagcaggacttacctcatagatttaagactaaaatgagaaaatgaatagaaatttttaggatagaattagtaattgtaatttacagttgcaagggttaattattccagtggcatagcacctggtattttcacctggccattatttgatgacatagctgttttgatagcagggccattttgactaatgaatgttttgatacagctattgccaagaaattattttacttttaacttggtaaaaaattgccaagcattgtcgaaatgggtaacttcattgttttatctctgaatgtcttccaattggtagtcccacctctgcaggtgttagatggggagaggctcagggataggattagcagttcagtgaggatgagataaggaccaagggtgtagtaagggttagagatagattagggagagggagagtgaaaggtcagaaatggaggaggatcaggaaaccagcatattcgtgactcaatttgttctaaactataatcatgtccaagtattctggttcaactggagagcaaccaagcaactgagctagcatgagcttgtgttccagagggtttgcattctgccagtcactagtcgtctgactttggctacattacccttctttaacttcagttttcttgtctgtaaaatagggatgactctatctaccacattgctttgttttgagaatcaaatgagaaaatctatgtaaagtgcttggttgagctgcttccttgctgcctaaaattagaagccctgaattcttttgacctaagaggtcctttaaaaaggtgaatatatcccttaattatgtattttctatagctgttacctacaaattttttttcagagaaattcagaaagaatagtaattcttctatagatgactttgcattttttagccatagagtatgtagttaatatataagcttttaatttaatatgaaaggattattttactatacatttgggtattgatgaagctatatgacacagagagttttgtgtaaatagtattttatacctgtgccatagttgtgtcacacttagaccccctttgttttactactttggaaacttgtccttgcttgttatttaactcatgttagcttcctgtccattttttttcctcttaaaaatttttaaagactatttttctgtagggcagatttatgttcacagcaaaattgagaggaagatatagagagtttttgtatatcatttgtcctcatgcatgtatagcctcccccattatcaacatcccctgccagagtggtacaattttttacaattgataaatttacattaattgacatatcattataacctaaagtccatgctttacatcagggttcacacttgatgctatacattctatgggtttgcacaaatgtgtaatgacctgtacccaccattactgtaccatgcagaatagttcattgccctaaaaatcctctgtgctctgcctatttatctttcctttcccactaacgccagaccaccactggttagtgtttacagtctccataattctgccttttctagaatgcaatatagttggaatcatgctatatgtagtcttttcagattggcttctttcacttagtaatatgaatttaagtttcctttgtgtcttttcatggcttgagagttcatctttttatagtggtaaataatattcccttatctggatgtaccacagttttttttttatctattcacctattgaaagacatgttggttgcttccagatttcgacaataatgaataaagctgctgtaaacattaatgtgcctgtttttgtgtgggcatacatttttagttcctttgggtaaatatccaagagtatgagtgcgagatcatgtggtaagagtatgtgtagtttttaagaaaccaccaaactcacttccaatatggctgtaccattttttgcatcccccacctgcaatgaatgacagtttctgttgctgtgcaatctcaccaatatttggtgttgtcagtattctggattttggtcattctaataggtacgtagtggtaacttgtcattttaatttgcatttctctgatgttatataatgtggatcatcttttcgtgcttgtttgccatctgtatatcttctttggtgaggtatctattgagatgtttggcacatttttttaattgggttgtttgttttcttgttattgaattttaagtgttctttgtatattttgataataatcctttatcgatatgtcttttgcaaatgctttttcccagtctgtggcttatcttctcatggtgttcacaacgtcttttgcagagctgaaattttaattttaatgaaggccagcttattaattctttctttcatggatcatgtctctgacattgtatctaaaaagccaacaccaaacccaagctcatatagactttttcccgtgtatcctttgaggagttttatggttttgcattttacatttgggtctctgattcattttcagttaatttttgtgaagggtgtaaagtctatgactagatttatttatttaaatgtgaatgcttccttgtttcaggtccatttgtgacaaacgcattttcttctttgtattgcttttgctcttttgccaaagatcaattgactgtattaatgtgggcgtatttctgggctctctattctgttccattaatctatttgtcttttcttttgctaataccatacattcttgattactgtaacttcatagtaagtcctgactcttcccctacttctaatttgattacttgaaggaccttataaatcttttaaataactttcaggcattttagcattctaatcctctctcactttcattatttttgtgtgtgtgtgtgtgtgagtaccttagaactctaagccctctacattttacattatgggttgtgggaaattatagagttttctagattccaggctatgtcttcttttgaaccattgcactacacatattgtgaactataatggtttactaagcaatttcagatcacttatctcattaagccttttgtttctgtcaccatcattttacagagaagtaaattaaggcccctgaaaggcaaataatatggccaagatcacaaattttccagcgagttacctgttgtattttcaatacattaaaatgtggtgttaattcacaccttattttgcctacaagcaaagcttgagcaagggggaaggtgtgatgggcccgtgcacatctcaatttctccttccttacccaacctcctcaaaataatttttattaccctagctttgccaaaatgagttcatcttcacatctctagtaatttcctaacactgctattatttatgtgagctctaagtcagtcgagccctttgtttattgtgattattgttttcctgaattttgtcccatgaagtgattcccaacactttttctgttgggttaagaatattatgatttaaatctgtggattgtgaaaaatttctactagttgaaagtctttcagtggcctataatttaccttatggggtagggaagtatgcaagatatgtattaatagcagatttggaactatggaagaggtgaaagatgtggaatacctaaaatatcagggaggtgctcaagtaaataaatactcatatcattagatgcatatttatgtgtgtgtgtgtgtgtgtgtgtgtatgtgtgttagggggaggatgtgtgtgtgtatgtgtgtgtgtgtgtgtgtgtgtgtgtttctcttatccctgacttactagggttgtttcattacagcctttgaaaatttggtaaactgtctatagttcagttttttgtgtctttaaaacttcacctttcaatgtaatatttcattgtccacatagctgtcaaagtttggccctgtatttacttagggagaggaagaactgagtccttgacatagagcatatatgcaaatcccactaacttacccctggtgtaattctgtaggcgtgcatgtggctgcccatctggtgaatgccctcaacttctcagtgaattacagtgaagactttgttgaactgaatgcagcaagataccgagatgaggtgggtggtctctgtcttcccatttttctttcacttgtcatgagatgactaatgagggtctgtgatttttccctgaaaatttgtaccttactgctccttttgagtgcttttaaaatgcagttgtcaagttgagctttattccttttcagtagaaaatataagtaattactatttcatagtgtctcctgctgaaagtgagagttggtagaatgtctactttttatattgcaatgttcagatggttgccactcaggtctgcctctgactcccagcagcttttgtctaattcctatcattcagctgagagtgttgacagtgccgttacagggtaaaaatactttataattcacatactgggttttggggaaaagggaagaaaagtaggttgattttttgtgaatcctggacaaatcaatttatttgacttaaaaaatgttagtgagttttcatgattcattcatttaaaaacattcctcgaattaagtgatgttgaattcaattctgtagcaggcaatatctgacgtagagtgcttttctccatgtgaagccatccatgaaatgaaattatatttgcaaggtgcaggccagagcctgatgaacagcacatgctcagccagttaggtctctgttggttgatgctttcatacagtcctcaggctgcctttgcttcacaatgccaagactacatcaaaaacaaactgttctgtcccatttaaatcagcatcccccccccttattttcctgttctgcagactaagtttggtagtgacttattaacttttttccccaccttccccactcctttttcccctccacatatcaccagagttttctaggtttaatactgttgtgttcatgtgtttgacctccatctcaaaacaaaacagaggaaaaagtaacaacaaattcagaaacaaatcacaaaaccaaaatagccagcaacttttgatatagcccttgtctctattggtattttaaaaaataccaacatgatctaattagtcttggatgggaggcaggcattgataatttgtaaaaatttaccaggcttgtagagtgcatccagcactgagaaccactgaaaaattcccgctccttagcaggccagtgacagcgcttcacatgtaatttcagacccagcctccacttctgcccatctcacttccacctgcttccctttctcctgctgccctctgctcaaatcactagctacttgtttcctgcccctgttccaacatttcctttgtttctcttttccttcttttcttctcttttcagaattcatgtctttaataactttaatggttttctcattttaatggaataaacttttgcttaagttccaatatttttagtgatttcaaaattttcagttattaaatttattttctttgaaaagttatacatgctcaatataaaatattttaaaactctcaagtaaatgaagttaaaagtgaaagcttctcctccaaaacaagccacagtttattatgtttttttctgatattttgagtcgcattttatggtatatattccttggcgatttacttgtttgcataaatatacttttatagcttattgtatcaacatatcttaatctatctcattctctccatatgactatgccataatttatttttagtctttttcttattcagacatttagattgattctagggttttgttctgaaccacactccagtgaatgtatttctttgtcctcttctacacagatctgtagttgtagaattttggtttaaaaggttgtacatttttagttttgatggacagtgccaaattcctttttaaaaagtcttctcctgttttcacacttctaactaatattagaatgcctatttctacaactcatctctgtttttttttcccaatctaagggatgaaaatggcaactcaatgttttaagttagtatttcccctgcctttatttcttcttgtattccttctttcatgtctctctttatgcttttttctctctttttaataaatatgtatttagcatctaataggtacaaggccatgcattagatgtagatgaaaataagtgtatatatacttatgtatttaaatattatgtaaataaatatatggcatatctattatatatagattatattttatatattgatatatttatatattgatttatatatatatatatatatatagtcaacacatatgttattttgtgaagcacttttgaaaaagatggttttgtgccaatataccctattgttcttcttttatgcttttactctgcatgcaaggactcaccctccaccttgtgactgctgcacttccttgatagcccggctaaatctgcctcatcttgccactgtgaaaacatctctcactctcatgtttcattttctttctctagcaatattaattgttccatcttctgggttttcttaggtatttattcacatttctattcttaccactttgttcagcccatatgatatttttatgggttgtttatatattcagttttcttagatcaccctatagccatgtttctaatagttggaatagaagtcaattgaattaagccaggtgaggagctattcctaagcaagtggtccttattcaaagacccccagatgacactatatcaatcgtttccttcttagtacatagtctggcctgaccccagattcaatggaggcacacagaaagaaattcaaaagcttgtgaaatattaagcaccacggggataaaaaataaatccacaaatctagtggcgattggttttccagaaggtagaagggtgctgactataaccattagagcataagagatgtagtttaaaggaaatcatacaatattttagcaatattaatgtttcatatttctaagtagcagaaactggtttttatttgagtatcctcaccacttttcactatatttgaaacacagaaagctctcaattagtcttcttcgtactgagcttacaatgcgcaaatcccctacatattttattggtttttaattctgtcttcacatcttgtgatgcagtttcacggttttggtagacagagtatataataatagtttaacatcatggctaagatattgagtttcaaaatggtcaaagatgggcttaaaaccagtgccaccagcttgtaggtaaccattaagaataatttctgggccttttgagtcatccagtattttgcctcagatggatagatttctctgaattgggtttttacttgttgtaatctcctctagcattgtgaaaatgttatgaaacttaatcgagtctttctcacttccgttggatgaacagtattttacatgacaagtatgtggtttgtagatcctgcatactctttatagaattatatatcatcagtgctttagtttttaatcatttatttttttttctttttctcaggatcctagaaaacttctcttcacaactggtaagttgttattcttagccttttctttaggtttaggaacatctttaaaagtaggcattatcggactgggcgcagtggctcatgcctgtattcccagcactttgggaggctgaggcgggcggatcacctgaggtcaggaactcgaaaccagcctgatcaacatgatgaaaccccatctctactaaaaacacaaaaaattagccgggcatggtgggtggaaagtgcctgtaatcccagctacttaggaggctgaggcaggagaatcacttgaacccaggaggcagaaattgcactgagctgagatcgcgccactgcactccagcctgggcgtgacagagtaagactccgtctaaaaaataaaaataaaaataaataaaataaaactaagcattatcaaattacacaacaattagatatatgttacaaatataacatatggacaatttgcatgtaagaataaatatttggagttaaaggataaggttgcaatgagaacagagacaatgcaaacattggggtgtgaataaatggagagtaaaaataagcaaatacatttcactgtcgtatattcttccaatcaaaacaatgcaaccgcattcttattgagggcctgctttgtgcctgctgctgtggcaagtgctgtaggagataatgcatgtttaacaggctcctgccctcaatgtattggaaaggaacaccaagcactgtgggtatccatggagttcttataattcagtaatttagtgcaactttttttaatcttaaaatttacaacaaagaggagaaacagtcattaaaataagttatttctttgaaatgtgtctcctatttcatttgtaatttatttttccttttcaagcttattgtccatgaaatctcagtctagactattaatttgttaaagcacgtttgaacatctcaaaatttcccctgatgttaaacaatttttgctaaaagtcttctttttcccaaccttagatttataaagatgaaagaataaagatgcatttggggaatttttagcacatatttcagggacaaggatgattgcatagttgagatgctctatcataaattgttgggtgtaatacccaattaagtattggaattgcacatgggactgaggcacattaccctggcaaatgcattatttttcttttgaatcaattttatgatgaaacgtcacaataattctagtgctttccccatccatgtcacagctatatatttagatttataagatacattttacttttgtctatagatttataatacttgccacttgcaaagtatttcacagttttctctttaggaacacaatttagttttgctttcaactttgctcattgaaaacatgttttcatttaggcctgaagaattgggtgagaacaaaaagtacagaaaaagaaaactttacgtatcaaccaatgtattttttggtttacagtgaattcatttaagagagagaaacaaaagctttgtttaatattattttctaaaacataaagtttaattgaagccttggaacctttaaaatgctttgaaaagtttagtttacaaagacacaaagagatttgttatgtgactaagctatcacattaaggcactaatattattatactattagtagtattattattagtattgttactattagcactattatgattatactaatattactaatattatattaataatataatatataattatatattatatattattatatataaaataatatatattatattattatatatattttatattatatattatatatataatatataatatattatatattatatatataatatataatatattatataatatatataatatataagatattatataatatatataatatataatatattatacactatatattattatattattatattatattatattatatatagtattatatatagtatatatgatataataatataataatatatagtatattatatattatttatagtatatatagtatataatatatagtatatattatatagagtattatatatagtatataatatatactatatattatatatagtattatatatagtatataatatatagtatatattatattatatatagtatattattatatatagtgtgtaatatatagtatatatagtatataatatatatgctgtatattatatagtatatatagtatataatatatatgctgtatattatataatatacatagtatatattatattataattatatattatatattatttatattataattatatattatatattatatatattatataatatatagtatatatagtatataatgatatatactatatataagcaagtttaacatctcaaaatattttatatgtagtatatatattattatatattatatataataataatatattactatgttatactaatatactaataatactaatattattatactaataactaatacttcttataagcaggtaatctcactacctagcatgcaaccctatcatcctatgtcctttcccagaggtccccatgagtggtgttggacttagtagagaagacacttaatacaaatttcctgggtctaccttagtgtgtgtctgggaaagacttggcaaagtgttttactaaccttcccaggtactttgggagctgctgtcctgtcactactgaacatctcatcatactcttgagcataccgtctcgctactgcctgccttttgtattaggtatttattgtaagtaaccgagagataatttaaagtatgtgagaggatgtgcacatgttatgtataaatacttgagcattctcaaacttggtatctgtgaggggtcctggaaccaatcgcatggatattgaaggatgactgtaaaaatactgtgttgtagaatagtttatttccttacatgtactgtcttttccacttgtaggtgagcttctcttgggttgggaagggctgcttctagagtatgcagggtcctaggtaaacatttttttatggcctctggcaataaaaacaatttgactcacccaattcagcaaattagcaccattttggtggcccattctcacataatttcaagaaaagaagtactatgctggccagcaggaggcatccacttcccaggtcatcagtctggaactgggctcagacacagggctccctaagcgtgagtctggagctcctaaggcatctgtttgtccccactgaagactagcaggtgacagtgcaaagtagagtctaaggatggtaatggcatgaaagacacctttttctatcaatgaactgaatccaactttgtatcactaatgttgactaaaactattccacagccatctctgaatgttctcaggcacagcatctaggaaacattgcctcagcctcccaagtaactgggattacaggtgcccgtcaccatgcccggctaagttttttgtattttttttttagtagagatggagtttcactatgttggccaggctggtcttgaactcttgacctcatgatctgcttgcctcagcctcccaaagtgctcagattacaggcgtgagccactgcgcccagctgataaagagtatttttattagttaatagatttcatggatttttgtttgtttaatattacatagagtcttctatctctgtgtgttggaatttttttcaatggaatctagtattgacaaattaagattgtcttgtaaaaaataaagtctttggttatacaagtgacataaaatatagtggctaaacttactacataagaaatgttataaacattccaattaaggatttctaaggtaagattaatagattgaattatttaaatgttcatttaaaaatgcttactatatatctccaaatttggtagtagcttttatggtgagaataaaatggataatatctaactttaattttaaaaaccctcagaaacaaatataattatgtttccaattatgttagtaaaataggataatgaatagataatggtatatttctgaccacatctgggtatggatgaaaacaatctctcaggttcatctagaaattacaatgtcatgcaattattcattttaaaagctactaattaataaatttaatatgcataaatataaagccataagaataaacatgtaaacatgtattttgctaaggaaacaagtataggtttggcttcctaacttgaaggactaaaaaaattcacaggagaatcaaggtacttcacttggacaagcaactttgcccggtgagattagactagcccagtgatttccagccggtgttttcagactcttggaatgtgttgtaataaggctaatatattgggatttagctgagctgtcaaccaaggctagcttagggtgccctttgatgtgccctgaaagcactcagtgcttagctctctttacagcacttaatgccgtgtgttgcaatttcctgcttaacttgtctgtctccaccagtggactgggaatttttgtagagcagaatttattttatctctagcatttaacatctaacagtacactgtatatgcctacaaactgttcactgaatgaataaaagtcatttgtttaactcttttatttgatgcatagatcttcttgtaatatcccagataacagttacccctgactttttgatcactctgattatagtatgcttttctgcccttgctaattgtaagttcttcttcattgatctgaaatctattactttattaattgtacactttggtcttttttacttttgagaaataagaaggaaaaacaaattctttagataaaagagataactttataaatctgaaggaacatggaaaatcttcagatttattctccttagtttgcagatgagattcagtgagattggagttttgtgtaagggacagtaacaagagtataatcccagaccatatacatcattggctgggtcgtctggcccttctattttatcctcaaatgactgaagtaaactattttacttcctctaagtctttccaatatgttttcatgttctgacctaaaagcaatactctgatctaataagtttaagaaaatatttaagtttaatcaggtttcttgaatttaatacttctcagagacttttatacattaatgtaccctgtgactttttaaggaatggttatagtatttttagtaatagaaactaatatttcaaggaattaattttcaaataatacactttggaaattgtggctctattctaaacatactccatttttccaggtgttctttcgatgaagtaatttgcagacatcccatgactaattttggcatgttcaaaactatataggaaagtgtatgcagacatagaagaacactaataaaggcccaataaaatattggaaaggcccctctaactataatttcacactatgtagccatctgggattctatcatttagttattcatgtggacaaataaaggttttcttttttaacacttgaaaacagtgagactgacctcttcttttttctctcaaatttatgaaattataattgaagtacactaattatacacatgtatacaatttgattggttttgatacatacatatatacacatacatacacaatagtggaaccatcatcaaaagttagatgataaatatttttattatcacagaatatttttgtgctcttttataacgcatcttgccctctacccctcctagcaactgatctgctttctatcactgaagaatagtgtgaattttctggaatgttatatacaaggaatcatagaatttgtactttttcaggactggagtggtttagcttcttttattcagtctaacaattttgtgattcatgtatattgttgcttatctatcaacactttattttttttttattgctgattaattttccaggtacagataagtaccacaattgtttatccattaatctgttgatgaatatcagagtcgtttatagactttgactgttaaaaataagtagctatgaacattcttaaacaagtctttgcatggatatatgtttgtttcttttgggtaaacacttggaagtgcaatggctgggttactttgcaggcatgctatttttccaaaatagtgtatttttcatgctgctagttctttagagtgaactagactagttatcttactcatctcttacaactgggaagtaagcactcactgtaggaaatggaaaaatcatgaaaaaggaagtacttttcctctaggaaggaagcgtaaagaagaaatgatttggattaggtacattagggaagggcaccttttgttaggcttctaaaactgtctactgggaaagtgaggaggtgcgagtactcaagtgctgagaacccatagactaattctcttatttttcatgtggtgctttataagtgaaatttgtttctactgtactgagatttcgaatgctgttattttccagtgattctaactctggaatcctaatgatacacacctgtgttgctcttacattgtacacaaggtgtctgcttctgctggtggctcatagtctatgacagaccttctatttcatagtagttttcttgacaaggaaagaagcagaggaatgtcacttttccagatggaattgtcccaatagcttttctttgtagtctgatttaagattatctcagatgggatattcaggacttactgttgcttgtgagagtaaacaaatgtaacttattgacaggatatttaattttgtaataatacaatactaaaggagaccattgacactttagctgtttaggatattgtttttcagttagctattcattttggacatgctatatgtgctaatgttggatttgtagcaatctatcctgccattataattttgacaatatatttgcacattttattattttaaaaaaacaaatgttatgccatatctgaagcacttgatttcaacatatttttcatactaaggagaaatatgtctgcaagtatttttaaaacatcaacattgtagtttattctagaaacctccaatttttgttctgtgttttgtgatttttgaaaacactttaggctttattttttgtttaaaattattctagttagtgaagcctaaaagcagttaattgaaattgaaactgaaggcactgcttagtttcataagaggaaggagagcatgagggagatttagtactatggtgtttaaaaccaaaacagaaagagtgctgaaagttaaccctgtcctgttgcattaattactgatgtttagtgtatacttttagaagtaagtacctatttgccattctgagtagaatatttgggaattaaaaaaaatggaatattctgtaaaatagataaaagatcctgattggtctaaacgactttgaaactgtactgattttaataagttctggtgttctgtaccactgtagaatgactatagtaagcaataatgtattatatgctttcaaatagctagaagaaggatattgaatgttcccaacacaaagtaataataaatgtttgagatgatggatggatatgctaattactctgatctgatcacttttactttatatgtatggaaacatcactatgtactccatagctatgtataattattatctgtcaatcaaaaattaatttaaaaaattaaaaagtaaagggcttgtttgagggagaacatacatgtagatgtgggatttgaattaggcttcccacagaacagcacagtatttcggattctaatataatcattttttgtatttttttctcactatgatttaagtaaaaacctacttgtatacatttttatagttcctggcctgacaggggtctgcatggtggtggtgctattcctcatgatcacagcctctacatatgcaataaggtaagtgtcagaatcaattattttgatgtgtatctgtcaggttatttagaaaaagtcttgagtaatcaaaatgtttaaccattgtagtgtcctggttaatggactattctgggtaagtaagagtgaagtatagctgtttctatacatgacttcttgtttctgaaagttctcttgtattagcaaattttctggattggtaagaaattgtgtatggagactgcatttgatgatcaaaagaattagagttcttcagaatttgagtatcttttgaaggatagtgtatctctatgggacacgggattgaaatcaatgtgtacatatggggaccttagaaattcctaggaatatgtgacttaaaattattttattttattatttcattatttttaagatttaacattgtgattttattttattttatttatttttttattattatactttaagttctagggtacatgtgcataatgtgcaggtttgttacatatgtatacatgtgccatgttggtgtgccgcacccattaactcatcatttacattaggtatatctcctaatgctgtccctccccctctcccaaccccacaacaggccccggtgtgtgatgttccccttcctgtgtccaagtgttctcattgttcagttctcacctatgagtgagaacatgtggtgtatagttttttgtccttgcgatagtttgctgagaatgttggtttccagcttcatccatgtccctaaaaaggacatgaactcatccttttttatggctgcatagtaatccatggtgtatatgtgccacatattcttaatccagtctatcattgatggacatttgggttggttccaagtctttgctattgtgaatagtgccgcaataaacatacgtgtgcctgtgtctttatagcagcatgatttataatcctttgggtatatacccagtaatgggatggctgggtcaaatggtatttctagttctagatccctgaggaatcgccacactgtcttccacaatgattgaattagtttacagtcccaccaacagtgtaaaagtgttcctgtttctccacatcctctccagcacctgttgtttcctgactttttaatgatcaccattctaactggtgtgaaatggtatctcattgtggttttgatttgcatttctctgatggccagtgatgatgagcattttttcatgtgtcttttggctgcataaatgtcttcttttgagaggtgtctgttcatatcctttgcctactttttgatggggttgtttgtttttttcttgtaagtttgagttttttgtagattctggatattagccctttgtcagataggtagactgcaaaaattttctcccattctgtaggttgcctgttcactctgatggtagtttcttttgctgtgcagaagctctttagtttaattagatcccattttcaattttggcttttgttgccattgcttttggtgttttagacatgaagtccttgctcatgtgtatgtcctgaatggtattgcctaggttttcttctagggttttgatggttttaggtctaacatttaagtctttaatccatcttgaattaatttttgtataaggtgtaaggaagggatccagtttcagctttctacatacaactagccagttttcccagcaccatttattaaatagggaattctttccccatttcttgtttttgtcaggtttgtcaaagatcagatgattgtagatgtgtggtattatttctgagggctctgttctgttccattggtctatatctctgttttggtagcagtaccatgctgctttggttactgcagccttgtagtattgtttgaagtcaggtagcgtgatgcctccagctttgttcttttggcttaggattgtcttggcaatgcaggctcttttttggttccatatgaactttaaagtagttttttccaattctgtgaagaaagtcattggtagcttgatgaggatgcaactgaatctataaattaccttgggcagtatggccattttcacgatattgattcttcctatccctgagcatggaatgttcttccatttgtttgtgtcctcttttatttcgttgagcagtggtatgtagttctccttgaagaagtccttcacatcccttgtaagttggattcctaggcattttattctctttgaagcaattgtgaatgggagttcactcatgatttggctctctgtttgtctgttattggtgtataagaatgcttgtgatttttgcacattgattttgtatcctgagactttgctgaagttgcttatcaccttaaggagattttgggctgagatgatagggttttctaaatgtacaatcctttcatctgcaaacagggacgatttgacttccttttttcctaattgaatatcctttatttctttctcctgcctgattgccctggccagaacttccaacactatgttgaataggaggggtgagagaggacatccctgtcttgtgccagttttcaaagggaatgcttccagtttttgcccattcagcatgatattggctgtgggtttgtcataaatagctcttattattttgacatatgtcccatcaatccctaatttattgagagtttttagcatgaagggttgttgaattttgtcaaaggccttttctgcatctatggagataatcatgtggtttttgtctttggttctgtttatatgctggattacatgcattgattgcatgtgttgaaccagctttgcatcccagggatgaagcccacttcatcatgttggataagctttttgatgtgctgctggattcggtttgccagtattttattgaggatttttccatcgatgttcatcaaggatattggtctaaaattctctttttttgttgtgtctctgccaggctttggtattaggatgatgctggccttataaaatgagttagggaggattccctctttttctattgattggaatagtttcagaaggaatggtatgagctcctccttgtacctctggtagaattcggctgtgaatccatctggtccttttttggttggtaggctattaattattgcctcaatttcagagcctgttattggtctattcagggattcatcttcttcctggtttagtcttgggagggtgtatgtttccagaagtttatccatttcttctagattttctagtttatttgcgtagaggtgtttatagtattctctgatggtagtttatatttctgtgcgatcggtgttgatatcccctgtatcattttttattgcatctatttgattcttctctcttttcttctttattagtcttgctagcggtctatcaattttgttgatcttttcaaaaaaccagcttctgcattcattgattttttgaagggttttttgtgtctctgtctccttcagttcttctctgatcttagttatttcttgccttctgctagcttttgaatgtgtttgctcttgcttctctagttcttttaattgtggtattagggtgtcaattttagatctttcctgctttctcttgtggacatttagtgctataaattttcctctacacactgctttaaatgtgtcccagagattctggtatgttgtgtcttttttctcattgttttcaaagaatatctttatttctgccttcattttgttatgtacccagtagtcattcaggagcaggttgttcagtttccatgcagttgagcggttttgagtgagttcttaatcctgagttctagtttgattgcactgtagtgtgagagataggtataatttctgttcttttacatttgctgaggagtgctttacttccaactatgtggtcaattttggaataagtgcgatgtggttctgagaagaatgtgtattctgctgattggagtggagagttctgtaggtgtctattaggtccgcttggtgcagagctgagttcaattcctggatatccttgttaactttctgtctcgttgatctgtctaatgttgacagtggggtgttaaagtctcccattattattgtgtggttgtctaagtctctttgtaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtgctcctgtattgggtgcatatatatttaggatagttagctcttcttgttgaattgatccctttaccattatgtaatggccttctttgtctgttttgatctttgttggtttaaagtctgttttatcagagactaggattgcaacccctgcctttttttgttttccatttgcttggtagatcttcctccatccctttattttgagcctatgtgtgtctctgcatgtgagatgggtttcctgaatacagcacactgatgggtcttgactctatccagtttgccagtctgtgcattttaattggaacatttagtctatttacatttaaggttaatattgttatgtgtgaatttgatcctgtcattatgatgttagctggttattttgctcattagttgatgcagtttcttctagcatcgatggtctttacaatttggtgtgtttctgctgtggctggtaccggttgttcctttccatgtttagtgcttccttcaggagctcttttaggggaggcctggtggtgccaaaatctctcagcatttgcttgtctgtaaaggattttgtttctccttcacttatgaagcttagtttggttggatatgaaattctgggttgaaaattcttttctttaagaatgttgaatgttggcccccactctcttctggcttgtagagtttctgctgagagatcagctgttagtctgatgggcttccgtttgtgggcaaccccacctttctctctggctgcccttaacattttttcctttatttcaactttggtgaatctgacaattatgtgtctttgagttggtcttctcgaggagtatctttgtggcgttctctgtatttcctgaatttgaatattggcctgccttactaggttggggaagttctcctggataatatcctgcatggtgttttccaacttggttccattctcgccgtcactttcaggtacgccaatcagacgtagttttggtcttctcacatagtcccataattcttggaggctttgttcatttctttttactcttttctctctaaactcttctcacttcatttcattcatttgatcttcaatcactgataccctttcttccagttgattgaatcggctactgaagcttgtcattcgtcacgtagttctcgtgccatggttttcagctccatcaggtcatttaaggacttctctacactggttattctagttagccattcgtctaattttttttcaaggtttttagcttctttgcaatgggttcgaacttcctcctttagctcagagaagtttgatcatctgaagccttcttctctcaactcgtcaaaatcattctttgtgcagctttgttccattgctagtgaggagctgcgttcctttggagggggagaggcgctctgatttttagaattttcagcttttctgctctgtttttttccccatctttgtggttttatctatctttggtctttgatgatggtgacatgcgaatgaggttttggtgtggatgtcttttctgtttgttagttttccttctaacagtcaggaccctcagctgcaggtctgttggagtttgctggaggtccactccagatgctgtttgcctgggtatcagcagtgcaggctgcagaacagtgaatattgctgaatagcaaatgttgctgcctgatcattcctctggaagctttgtctcagaggggtactcggccctgtggggtgtcagtctgcccctactggggagtgcctcctagttaggctactcgggggtcagggacctacttgaggaggcagtctgtccgttctcagatctcaaattccatgctgggagaaccactactctcttcaaagctgtcagacagggatatttaagtctgcagaggtttctgctgccttttgttcggctatgccctgccccccgaggtggagtctacagaggcaggcagtcctcattgagctgtggtgggctccacccagtttgagcatccaggccactttgtttacctactcaagcttcagcaatggtgggcgcccctccccaagccttgctgctgccttgcatttcgatctcagactgctgtgctagcaacgagtgaggttctgagggtgtgggaccctctgagacatgcgtgggatataatctcctggtgtgccgtttgctaagaccattggaaaagcacagtattagggtaggagtgacccaattttccaggtgccatctgtcacagcttcccttggctagccaagggaattccttgaccccttgcgcttcccaggtgaggcgatgcctcaccctgcttcagctcatgctcggtgggctgtacccactgtcctgtacccactgtctgacaagccctagtgagatgaacccagtacctcagttggaaatgcagaaatcacccttctctgcgttgctcacactgagagctgtagactggagctgttcctatttggccattttggaacctttgttaaaattattttaaagctattttcctgatatgagtttgtcttgctgtaaattaacatgatgttctatacaaaactttggagaaattgtttgtttgcatctgctaaaataacaaattatctgcattcatattgattcttatagttaagagattttgagcaaaatcagatacacattatcaggagcactttcacatgtcctttctaatggacacattcagtttttcagaatatttatagtgttgatgcttctgaacaaactttttagttaaagaaagcaaaaaaaggaatataagatatatttcctctaatcttcaagaatctccaattgttctacttgttcagatgtgaaatttaacagaaacacagatatatatatatgtatatatgctttgaaagtaattgccaaataatatacttaaatgaaactgtctttatagtttttaacctttgtgcacacacatacatacaccctaaaatttcacaagtctactcactacccaaagattaatactgtacatatgtagtgtatttttatagattaaatccttcttgctcttcttcactaattcccctcctcctacccccaaatcattttttctctcttatatacatatgtattttaccaaaataggaccatattagagtattacttttaatttactttttgcctaaatttatattatgaacatttttacgttaataaatattctgttattattctctttactgatggcacagcacatcgcaatataggtttttatacattattttcccagacccatattactaaatgttttgggtagattttgttttgtttttttttttttttggtatttcaattttgaaacaaacacccccatccatatgtctttgcatgctttttcaatgatgtcctaaggaaaaattcttagatgtagaatagctgagtcaaattgtaagaacacttttaaagcttttcataagaatgaaaaattggtgtacagaaaggcaactcactaacatcagtacatgagggtgccaattttgtggggagcaattttattttatttagatagaggaatcattaaaaaacctcactttttcaattttaggaattcttgaaggaaaattagagcatctgacatacttattttaaaatccttgaggtatagttttgtcaaatggaataaaaagatcagcttcaatcctgagcttttatatttgctctcataaacaatttaagcccttcctaatcttcagtgttttttatgctttgtttaaaatttgtttaaacaagattataacacctagtttgcttttctgttttattgttagaatcatgaaattcttaaatgaatcatggagacagatatctcttttattttaccttttctttttaccagtaagaaactaaagcactagacaaatcaagtgaatgaataagtccccagtgtttgatttctgatagtgaaatgtagcctcctaattcaaggagagttcaatatgggtcaatctgttaaaataattaatgtatcccgttattagatgacaggaataaattttctcatctcaattgattttaaaatggcacttactaatatgaactcaaattttgacttaaaataatcagagtaaataagctaaaaattaaaattatttacattgtagaattaaaaaatataaaagccagtattggggttatactcaagagtgaaacactagatgtattcctaagaaaatcaggaaaaaagcaaaagtatttttaattctaccaatatttacatatagtaaaaaatgaaacatttggaattattagaaaaagtgcaacaataaaataccattatttccagaaaaagtagatatatctactttttctggaaataatggtaattattaggtttctaagagaatccaagagaattacggaaaaatttggtgttaacaccaagtaaaagagttgaaaaggtaattggatataaatcaaatataaaaataatccttttattaactataattagtttgaaaaattgaataaaataaaaatataccacttacgattgcagcaaaacatataatatctggagacaaaagatatatgttcactaagagaaatatgtagagatttgaataaagactgtgtactataaagatatagttcttccttaattattatatatatatttttttgagacagggtctttctctctcatccaggctggaatacagtgataagattacagctcaatgcagccgcaaccttgacctcccaggctcaagtgatcctcccacttcagcctccctagtagctaggatcacgaacacacaccaccatgcctaattttattttttttaattgtatttattttttcgtaaggtcaaggtttcaatatgttgtccaggctggtctcagactcctgggctcaagtactccttccacctctgcctttcaaagtgttggattacaggcattagccaccatgcctgacccctcaatatatatatatatttttaaggagtgttgcaatttcaacaacgttctcagacaggttattttgtttgttttttttaatttagcaaagtgattccaaagtttgtctggggtacatccaagtacatatttcaaaagaggagtaaaaggagggatgtgccttactaaacattaaaataattaaacttcagtaacttaaaagagaatgggacttacttgcaaaaatgactaacacattgaaccaagggacaaagtcagtaaaaagccctgtaaatgaccttgcaatatataagaacctgcagataataaaggtggcattacaagcttatgaggaaagtaaagtttaagcaaatgtaggtctatctaaattacacatatgaattaaaaatactctatagaaatgggtaatgattataaacagaaaggtcacagaagaattaaaagtaacagacatatgaaataataccccatcctacttataaaaaataatgaaaatttacaaaatttagtctgagtttttgggaaacaggcactcctagcctacagttgggtttgtaattaataaatatatttttagagggcaattggcagcgtgtattaaaagcattaaaaaggtgtatcccttaattttgcagttcaaattctaatggttttgatttaaagaaggatcagagggccaagcatggtggctcacacctgtaatcccagcactttgggagactgacgcaggtggatcacgaggtcaggagttcgagaccagcctggccaacatggtgaaaccccatctctaccaagaatgcaaatattagctggtcatggtggcgagtgcctgtaatcccagctgctcaggaggctgaggcaggagaatcacttgaaactggaaggtggaggttgcagtgagctgagattgcaccactgcactccagcctaggcgacagagcaagactgcatctcaaaaaaaaaaaaaaaaaaaaaatcagaactttgtatatgttacaagggatggtaatgatactgtttatgataccaaatactatgagtggagtaaatgtaaagcaattgcttgctgcttaagtaagggtttctctaagagtctatgggaagcatcagattcatctaggaagcttttgtaaatatctgccctctaattccaatattctaatatataaaatccacccaggatatatgaaataaaataactgtttctcttttacttctctcaaacattctgtagattatgcttatcattctctgtcttttcagtgtctttgtcctcccccagagcaataacattgaggtatcattcttgttacactgtccaggaaaaaatataacactttggtcgtcatctatttcatttatctctttttgagtttcccttgaactactctcaaaatatgtattgaaagaggagctttggttgttttggaaattatttgaaaactgagaatattgataaaataatagccaaagtacatattagcagactactatctgcttcttagccttatatcataataacttgaaaataaacaacttatttttattatttccatgtgtctttatttgaaatacaaagaacttacaaaatgataaaatcttactcataatttttgtcatttctctctatatactgtgttaatactttggtattagtagattaatatgatgtactcatgttttagcttttttaaattgtgagatgtttgaaatgatacatggtatttttgatatttttagtaagatggaatgtaaagtagcattaaaatgagtgtatttgtttttgcagagtttctaactatgatatcttctggtatactcataacctcttctttgtcttctacatgctgctgacgttgcatgtttcagggtaagtttacaaatgtatgtatttaaaaccatttgtgccccaaaatggggtaatgaaagaaaactctataggaaatttcataggaggtggtaaaagtgtcaagagtgaaagaaatagtttctctactattgaggataacgtcaagaatggaagaaatagttttatttttagcatagcatattgtaatgaaaccagtataaagtatactaaatttaaaagctagaattacctctccaacaacctttcagtttctaaatcttcctatggatatatcctaatatcttctaaatgaaaaaatttaagaatgaagaacatcaggaatatattttagtatttgtatttcctgaaactgtcctgctaaagcaagatttataataatggaatttccagtttttcattttaaaagttctacaggaagtaatacttgcagagagagccaaagatttaaaataaccaaagaaaaggatctgtcaaaatcaccaaggaaaaaaaacataaagtgaaaaaataatgtatcctaagcttattacaaagagtatacctaaagtattccaaaaatatgtgtacccaagcagtatactcaaaaacatggtgcttaaaacaatacatgaagatagatgaagaaaataatgtatttttgtacatgcatatgtctgtatggccaccggcagtgaacttgatggctttggcgtgacattcacacctgcatgacataataagtctggcagcagttttacttggtttggcaagatacagggcaggacacacagaatgtcaacaggataatgtcaggtgcttattaagtagaaatccctatatttgctcagaagcatttacccccactccttcatgtagcaactctaagataagaaacccatgtgggtaagcatggtctaccttgcattgggtaaggctcattcgtactccacaggaacctgtatcttgggaacagcataggtcccctcaagggatgcccttgggatcaagaacacactgtacacaaggaggctgaggtctgtgaggtccaaaatgatttcatagttcaatcacagtcctttctgtccagatgcatttcaccgataataaacaatgttgctggtaacacagctgacaatccctatttttcttaacctgaaatatttccagggaaacagtttgaagaaaggttcagacctttgtttagttctttcttcagaatgttttataatgtaatttatcagtacagtgggtcatttacattgatcatatatttatttcagggtacatattcaaactgttgctttggcttttttccccctgattttagagactgctgattaagacagcagtatcaaatatcccatatgtcctggttagctttgttcagtaccaaggttccagaacacatagttgtagagcactggaaacatggccacacattataactaattctctggagcctcagggcaccgagaaagcccttggtagataaaagactgctttacattctgctctttaaatgggattggttacctgtccagggctatgctcctgaagaggactatgaataaccagatacaactaatgataataacagtaatctaaaatagttacataatgcttactctatgctaagtataaattcaaaatgcttcacatactttatgttattaaatgctcagaatgttatgagaataaataatattgttaaacctctttcagaagtgggaacactgatgtttagaaagattaagcagcttgttgaagtttacttaactgatggatcctagattcaaacctaggcattctgattcagaaactcctaagtttttactacaaggctttatttttttggagaggtctgtacttctgagaatttgatgttagtatttgtttaaatgcctttatctttactgctttgagattgtgatctgtctattcatctatgtccctatatcagatagatatagaaaataaaaatgcaatcatttattagtataattatatattattttgcctttatgttttactaaattaaaactctgaaaaaaaactatttctttgtaaatcaaaatagtgtcaattttttgttaaaggatcagcatttcaaacagacttctttttaaagaggaggattacattgagagttctttacttttttggaagtaaaaggaatgcatatttaaattttgatttttacttttatagaacaagtgtcatagaaagtgactttaatttatacagagaaatagtaggcatctataggatgaattatatataatcaatcaattattaaactaaattaatatgtatttattcattataggtagaaatgaagaaagcaattattctaattttgaaatatgtcatgcaacccatacataatacaataagcattctacagtgcacattttttccaggaaatttaatagatatgcttctggtatgagaaatgttactactgataacattttaccattttctcaaaattaaaaaaaaactatactgatgaaggattggcttataattaagtctatttatttgtgcaaatgttggaaacagacatattttaacttctgaaatacctagataactttgttcttcaacttttggttatacaaataaagtacaattgttcaaagtaaatttcttggatttatattgaaatttctgttcaacagtatgctttaggtctgaacagaaaatcactatttgcttagcattagcttctctgtccatcaatgtggtaagtaccataaggtaaagaagagcaatatattgcatgatgtctagtcatccagcattgatcattgatttggaattttgaaaaatcaattggaaaagctagacatattataaaactgcatatttttaaaatgtaaacattcatgtgttatttacatgaatgctagcaattcagagaattatcagtgtgggctagaaattctagaaaatattaggcttcaaagatgaggtgatgagacattgttgactggtttttctacctaagcagacttttacagtaagagcatttgcttcatatgattttctaaggtcatttttttcatagaatcttaaattttaaaggaagctgaaaagatatcttgatcaagcctcttttaagctcctctgcaatttatctactaagtcaatgcctaattttgaagatgtccattctgtcttaggggaagttctaattctcacaatgttctttcgtttttggttggaattattttactgtaatttctgtctagctatttaaaagtctgtgattctggaggccatggaagttaagtcgcccacttttctaaattctattcatctgtttctcacgttgtgatatttcagatctcaattttctgaactgtctcttcgaatatattaacaattaatattaattgaatgcttctcttttactaacatttgctctcattaaatcctcctaacaaccctgtaaattattattattattattattattattattattattattattattctcaatgttcagctgagagaataggagcagtgagagataagttgctgagggccatggctagtaagtagatttccagtttgaacccaggtatcaggtaccaaaattaacattcttaaccactaagttatgctggcccccatttggcaacacttctctgtatcccttttaaaacttacaccaaactaaatgttcttggagtatgtgatctgattttggcagagtgaaagtctcactttcttcactacaaacattgcaatcggtattatttaggacccaaattttttgttctatgattatctgtgcccttggcttaacctggttttcattcttgttgtatattttagcgattttcttcattttttataaataaatctgttgcatgccaccctaaaaagatgacatttcatgtacactaaactagatgtttctttttagtgttaaaatacatctttaaaatacattaattttcttctccaagatgttagtatattatagaagttaaaagatacatcacttaatacccgtatgaacttggcagataatttgtccttgctttttgttagcaattaaatgggattaataaaatcacttatatcatagtgttgtcttgggtttaaagtaatgcagcaaagtaggcagaatatagacatacttaataaatgttagtaagaacaaattatactagtaccaatacttatagctttgtaagaatgacactccacatttaactttgaaaaatcaggttttttgataaagacacaacacttttgaaaaacccagattttcttatcaacaaagtaatttgatgaacatagtgaaaactacttagcagctcaaaggaatattccttgatatggcaacaattataatattctaagatctctaacattctattgatttttagcaataaaggtttatctttgcaaaacaagccttcctcctgaggaattttttgttttgatttttaatatacctttttgggaggttgctattggtgtgcttaggaatttaaaggtattcaattcctaagatacctggtgaaaacaaaacaaaacaaaaccatttcctctttccaaacatgtatagaactggatatctctttcctcattttcttttgaaaaactcagaaggagatgcatactgctattctcacttactgataaaaagagtattggagggaaaataaattacgaatgtcacagtctctgcttaagagcccaacccagctcctttcgaagaaatgtggagggaatgcattgtaaatgagatttggcaccttagcttctgcagtcttaccatagtcaacactcccactggctttagcttggagagtgctgtgtgggtggtgattgtattttatgtctttatttaactgagtgagagagactataatgtgataattctggaaatgatagaggggaaggtcctcctcaaatgtttggatgacaatgacagcacattaaaagtgtaaatatttttttgtgctagctctgctgcacttctcagatctttttattatatgaatgatacctgaattattcttttaagcagaactctttgccatttggcactacttgttagcaagagttaatcatagagcatgatttatattctacttgaatcattttttttctaggaaatctaaaaggagtatttttatgtgcatgtttttaaaaacatttattctttatgccaggggagcacagtgggcaggctttgtcaacagtgacattaatgaacccccggcagtgtcataggcggatagtttaacagggagcatcacaggagtttagactcaagatgttaaccagggttagacagatattgtgggggtcggcttattgtgctgactggaaaataacctccctctattatggcctcgggcctcaggaggaggacattaaggatatactgttagaggatagagatatttgtgcaatatagtgaagtgttaaggactgctgatacccaagtatcttctcttttagaagccactttcgtggaagtcttccttcacccacactgatgtggcagagggaaaagcttggtcatcttgctactggtgggaggcacttgctcctcttagaaagtcaaattgcattttgaatggaaggcccacaagttgtattttaaacaatcctattctagtactgagggagaaaatttttactttcctctatgttcttttcagtttcccatttcttgcctgtacatttgcagtgactttgtaatttattgtccaaaccagatacttttgagaatgaatggggatgctattgataattcagcagtggctatagaaaaaccaggtcatacaggtattctacctactcctaggcagtggggaaagttttaagagaggctaatgcactgttttaatgtagactttgagctagagccacaaaaggagtccttaccttgaataggggctctgtgtgtgtatttgagaaacagaaccttcaaataatacacactgtaggtttgcctagctttgtctcactttagagattgtaattagatgtccactaccatggtcattagaaggctgaggatttggttgttcatgacagtgggtaaaatcttttataaactctctgtcactgatatagatgacctgttctaatacttcctagatgcctagtttctaatgagtctggcatactcgttatcagtttggtgcccattacttctatcacaaaattctacttctctttccataggataggggtttttaacatggctccataatccctaggactaattgaatggattcagggattcattaattcctgaaatacatacacacacgtatctgcatatttatgtataagtttaattttgagacacatatgtatatttttgtataaaacaagtttctcaactttcattagataccgtaaagtttgtgtggtcaaaaacgtttcaaaaaatatggaactgaagtttttaaagctagattttaaccaaagagctgtaatatctaatatcacattgacacattttatatagcctacttcagttttatttagagttagaatcactgcattgtgggaaaaataaaagccactggggcattttttttcttccatgaaggctactggaaaaagaacttgacaaatataatgaacaacttaacaactgcattatcattttagaggataataattatactgttcataataattctctagttttagataatgttgactatgtgacagggactattcttagcactttacacacacacacacattaattttttgtttgtttttaatatgcacagtactataagttcttctatcatttctattttacagatggggaattgaagcatgaaagattaaattaagtaactgtctaaagtcacacagctaataactgaaaaaactaagattgagcccatgaagtttgacccctgaatttaacttctacccttttcttgaattattgaattatttatttgtcatttagaaagtactcttgcttatgaatgaaaaatatttatgtattgtaaaaatctaggatatatttttctattcgtccatgtaagttggtgagtatatatacatatatgtttgcctgttttgaatcagaagttcaattttgattcagggtacatagagttcaaggttttgaaggtgaaatctaactagctcccagaaaatggagtaagaagaaaatggcttctttatggtgctgcctgataaatgtttcctaaaatgtttgaccttgttaagatacataataatatgataactctataatataatgtaatcattttataataaatctaataataaaataaaaaaaatgtgatactttacttgccagaattcttccatgtaacctgaaaataacaatgaagaagactaggatttagactggagcagataaaaatgctgtggaagagatattcttatcagtattttattgccagtgtgtctttataaaaggattaagtcaaaacatagcaaagaaagcaatggggaaaatatattattcatcatatagaaaaatcaattaagtccacagatttccaaaacccataccttttagaattttgctatgaattttctctaaatattagattacccatccagttattattcaaatgtgtgggatgaatttgataatggaattccaaagtaaatacataaacgaacccaagtaagcatgcaatttgtgaattaccatagttttgctatcccacacattttggtattttgactttaaaaatagtgaaacaaatgccctgggttataatagtgaagaaacaggattgattcctagaagatcactaatcttagacaaatcagttttttatagagcttcctgatttgtgcaataaagaaaaataattgtatctcccagacctattagaagagaaatattagctatcatacataaaattgacactatacacacacatatacatatatacacatatatttttattgttgtctatgtaatgttctccatttaaaaaacttttctatttttaatttttatgaatacatagtaggcatatatgtttatgggatacatgagatattttgatacaggcatacaatgtgtaatgatcacatttgcataaatgagatattcataatctcaaatatttatcttttctttgtgttacatacaaattgtactgttttcattattttttaatgtacattattgttgactctagtcatctaattatatttttataaccaatactcatccccacttctccccctctcattcgcagcctctggtaatcgtcattctactctctatcttcacgagttcagttttcatttttagctcccacaaataagtgagaacgtgtgaaatttgtctttctgtgccttgcttatttcacttaacacaatgacctcagttccacccacgtcgttgaaaatgagaggatctcctttttgtggctgaatagtacaccgttgttatatgtagcacattttctttatccattcatctgttgatggacacttaggttgcttcaaaatcttggctattgtgaatagtgctacaataaacatgcaagtgcaggtatctcttcaatatactgatttcttttcttttgggtatatacctaccaataggattgctgggtcatatggtagttctgtttttagtcttttgaggaacctccaaacttttctcccataagggttatgctaacttacattcccaccaacagtgtatatgagggttcccttttctccacattctcaccagtattggttgttgcctgtgttttcaatataagccattttaactgtggtgagataatatcgcattgtagttttactttgcatttatctgatgatgtgatgttgagcaccttttcatatacctgtttgctatttgtatgtcttttgagatatgtcaatttagatattgtgcccatttttaaatctgattattagatttttttcttacataactatttgagttatttatatattttggttactaatctcttgtcagatggatagtttgcaaatattttcccccattctttgggttagatctttactttgttgatgtatgctttgctgtgcagaagctctttaatttgatgtaattccatttgtctatttttgctttgattgtctttgcttgtgggatattactcaagaaatctttgcccagtccaatgtcctggagagtttccccagtgttttcttttagaggtttcatagtttcaggtcttagattaagtcttcaatcaattttgatttttttaatttaggaagagatagagatctagttttattcttctggcatgttgtatttccattatcatgcatttcaaaaagttttaaaatttcctcaataatttcatcattgactcactggttatcaggagtatattgtaaaatttctgtgtatttgtatagtttccaaaattcctcttattgatttctagttctgttccattgtggtcaggaaaggtgcttgatattatttcaagtttttgaatgttttgagacttttttgttacctaacatatgatccttgagaatgacccatgtgctgaggagaagaatctgtgttctgcagccattggataaaatgttctgtaaatatttattaggtccatttggtctatagtgcagattaagtctgatgtttatttcttgattttctgtctgaaagatcggtccaatgctaaaagtggaatgttgaaatctccaactattgttgtatttaagtctttctctctctttagccctaataatatttgctttacgtttttgtgtgctgcagttttgggtgtatatatatttacaattgttatctcatcttgctgaattgacccctttatcacattatgatttttttggtctcttcttatggtttttgtcttgaaatctattttgtctgatattaagtatagcttctcctcttcctttttggtttccattggcatggaatatgtttttccatctgtttattttcagtctgtgtgtatcttcataggtgaagtgtgtttcttgtaaccagcagatcattgggtctttttgtttctccattcaaccactgtaagtcttttgattggacagtttatttcattgacattctatgttattgctgataagtatggcctttcttgtaccattttcttatttgctttctgattgttttgtggtcttctctttcttctttccttccatcctgtcttccttttggtgaaggtgattttctctggggttatgttttaatttcttctttttctattttttatgtatctgttgtatgttttctgatttgtggttacaatgaggcttgcaaccaatataacccacctcaggcccacagtgaggtactgcgtagctactgcctatgttcattcaaggcccaaggactcctcagtcagcttgtagtgaatgcttccaggcttgggacttttacttcaggataatgcattcccctctggcccagggagtgtcaagaaatgtcatctgagagccagtgcctggaatcagggaaccttgcttggtgctctaccccactgtggctgaattggtatgtaacctgcaagacaaagtcccattcactcttccctttccttttcttacgcagaaggagtccctctccataacaaccacagttgggaatttgctgggtcacacctaaagccagtacatctctcagtctcacccaaggcccatggcgagtactgcgtgggtaccactgctggttattcaagggccaatggctctttagtcagaagatgattaatcttgccaggactgggtccttctcttcaaggcagcaagtttcttgcttgcccagggtgtgtctagaaatgtcatttgacagttagtgcctggaatcagggcctcaggcctctgcccagggccctatcctactgtggctgagctggcatcccagaggcaggacaaagtcctctttattcatccctctcctctcttcaagcagaaggaagaggtctctcccagaactgtgagctgtgttgcctgagcttggtagagaggtggtgcaagcactctcttggctgctctggctagtgtctcactggggcgtgtgccacccacatcactggctgtgagccctgcacagcaccaggacttgcagggaatttcagtcctttaaacctagactgcctttcaagtttatttacaatcccagagcactttagcccaaaatggcaaggcttgctgagacttaggttttgactgctagaatgggcaattcctttttggctagtactgggtctaaatgctccctctgtgggctctggctgagttcctcctggtgttgcttttcattgtgacagggcaacactgagttctcttctccctaacctccttatgtatctgcgagttccaacccaaaaaagaaaaataaaatagaacattgtgccatattctaggtaaactatagtggttctggggataggagtgtttatttcccatctttatgcagggaatccctttcacatatcactcactcagtatttactggatgaagctgaattgcattaattagtttaagctaggaatgtgttgtccttctaggctcttccaattttcctcaagtatcaaggcattacagatgacaataaaggataatctctaaatttgtttaactataacttggactgtcattttgtaactatcatttatatttagtcttatctaggtaattagttattatggcaactagtatattgattcccacgccaaaggaattagcttttaaatcttaactattttgattatattgtagactggcacatttttgttcggggtctttatgcatttctgtggctaaaaaatctgaaagaaaagaaaacccatgcctcttattttattttattttattttattttttgagacatggtctttctgtgttgctcaggctggtctcaaaagtctggcctcaagtaatcctcccagctcagcccctaagtgctgggtttacaggcatgatccagcatgctcagacccagctctcctgatttgttttatttcactttttagttcttcaatttttcacttaaatatatggggtgaaaaatattattgaataattagatctctcttagatggaatccaaattcttctcctccataatatttacatattttcaatatgttaataaatacaatgtcctatataactatgatctttaagatataaagtttttttaactttatatcttttgtttgccaacttccaattttgtttgccaacttccaactttttattcattggatttttaaattttatgtaaaaagtagtatttctctatagtaattatggactaagatcttatggtttattcacatttgttgatattttatgctgtaagccagttggcagtagggattgaggtcatgtgatatttaccccattaacgatgccttacatttctatagcttgtatgtatatatgtctgcttatatacatatagtatatacagaacatttttatgtacatgaagtcatttatgctgtaagttgtatatattaatggattttcttaaacttccaaactgcgagtttattttttccccagttttggagatagaccaaatactttttcacataatttttatctcagtttttctgcagggaacttttttatattagccagtgttcacagctggtattacaagatgagaaagttgggggaaaggaggaggaaaaagcactgtatttatttaagaaacattttcagtatagtactttctgaaacatgaaataaatattttatcctccactgtcattttagtgaagcatgaaagctgaggaaatactaagaagtaatggatgcttacctttttttttctttgcaaggggtcaaagctcttccctttttatacccgtgaagtacagaggaacaggtactatttctctttttcagttaaggaaacttagggaaatgacctattttacttcaggtactcaaggaagttgtaaatgttgatcctaagcccttaagaccctaggctatacattagtcagctgcacagagattgtggcagaatcagctacctaatttgcagggcccactgcaaaatgaaatgtgggattctttgatcaaaaaattattaagcgtttggagataatgacaacagagcagtaaaccaatagcagggtctttctaaagagcaaggtccggtgcacctgcacagattacaaacacatgatgttattcctatcttgtaagcttggaccaccccaccagtaagagctagacacaattcctgctgtggttaagctgcagatgacagtactcttagctatcaaaggcaagagccaggaaagaatgcagaggcaagaactctgttaggccagaaaaacaaagtaggggtgggagtaaaagctttggtagggtgggtacccagatacttaggatttcctgaggcacactggatctgtagtttaggaaagcactctacttctaaatgcacctagcaagtagactttactctcttgataactgtctgttacttaatgttactgtctgttacttaataactgtcatgttactacatgccatttgctaaaatatagacctcctttttgaaggttgaaaatgaggtcaaatatctgttaaaaccagatgactccccagtcaagtgtttcaacaacaatcacaacaaaagttgtttatatacttctggtcactaagttaatcaatgaatatttattgagcacttattataagtcataagcactattttaggcagtagaaaaatagcagtggagcaggataaacccttgactttaagaagtgcacattctggtggattctacagaagttagagaactgcaataaattttaaaatacacaatttggttttattgtttgaattaaactctttttctttgtacttgaagcaaaataaaaataactgtcagaatcaagatatatttttaccataaagaaaaaaaaatcatattataaaatattaggaaaaaaagtaggttcctaagggataagaatttttttctcctccttcaagatagattaaaataccacaaatataaaggtcacataagtgacactcatttgtgggatatttttaacatgaaattaaagtagggatgattctggcattgtccttttgtcaggtgtggtattttgtaatatttatcttttgccataaaatcatgttttgattaccataaaatcctgttattacttagtaggattcatttaatgtattatattattttataagactttgtcacagccgggtattaaaaagaaagaaacaaacagaaagcaaaacaaacaacaaaaacaccaagatagtataattataatgcctcttgagggaaacaagggaaaaaaaagaaacctacaactttgaaacatggttgaaagtttgatagcacatgttaagatccttttgaatgcagaaacaattttgaaactccataaaatcctttatttctcatgataggagaacactagacattccacagatacttcaaaatttctccttggaacatcatataatgaaacttaaaacattaataataaacacttatatttccacatagtctgtgcacctcctttcctcatccctcaccatgtcattataacttggcaagactctctgtttaccattcactaatgtctttttcccttcttgttttttgctttaaaattatttagcatttgtttatgaaagctacaacaatacatacaagaatgctgtctttttgattcctacatgatttgctatattaaaacaaattatgtgtttattgtttgcttttaaaatcaattcactagaaatgcattagagatctattatgtgcaagaaaagtattagagggatgcagaggtttggcagtgagtatgaatgtataagggataaatgcataagacatgatcccttctacttattcaggaataaaccaagtacctttgtgcatatggcttcctcatattggaatgccattctcctattctctaacccctggaatctctacatccttcagctgccttcttctctgtgaagcctttctggaattttataatcaaagttcattacccatctctactctcaagaggttatcatatgtttatatggcattaataattttgccctttttaattatcatttttggttctatgtttgatttgacccattatatctgtgctgtggctattcaatttaaattaaagtgaaatagtattaagaattcagttcttcacctgtactagccaaatttaattgctcaatagccacttttctctaatagttactatgttggtcatcagagacttagaccatttccactatcacagaaagctctattggacagtgctgctctagactgtgcatgcctttgaaggcagtgaccataatattgaaactaataagattccaaaattaataaaataatatgtctaaatgaggtatatcacagtggcggtgtggggcaagaagcaggggcagtattgtttggcaaatagacacagagctttgtgttatcttaagtgggttctgttacatttgagaagatttcattctactttaaagaaaggcatgcatctaaaataaataaaggtaccaggaatttaaaacaccataaaaatcatatagaacatgtgcctcaaattttaataaatgtggccacagtgaagtaaatggattagggagataatatcagattttgtctatcaatccaaatatccttaatatctagtctacattccttttcaatattctttagaaaaagattgttataatggccttcaaatataagaattctaagaaattctgcactaataccaaagaaatgagcacttttactctttactcatacaatgaaaaagtaagttattgcattcaattgagcttgaaaaataacacataaaagtattggtttgataaaacatgctccctccgtttctaagtctatagccatataaagccatcaaattttgctcaatgtatacattggtcttcaatttaaagattgtccataaagtagtgtggatattttgcaaggggaataggcctggtacagaggaaggagcacagactttggaatcagactaactgggctttcagtcccagctctgcagactgacattattgtgttgggagatacttaagtactcccaatctaaggccactaatctttaccatgcaagtttttttttttttttttttttaaccagtaggtggcctttcaatactgagttaaaaacctgccttccagtgaactttcagtaccttcaccacctaattacagccaaatgacctgggatgtcatacttgagtttttttttttttgatgaatgattttatcattgtctgtctttagatcttatccatatttctttggtggcaagagttacaactaagacaaagtaatctgagctctctattctgtttgttttttgtgtttttaggcatataccatattgtttttattactatagtcttgaaataaagcttgaaatctgaaagtaaaaaaagaagacaaagtaaggacagttttaatggggttttaggacagagatggcctatgctatttagcttgagtgtagctgaacataatacaaagctctcaaaattaaaaggaattttagaataatacgtgccactttatgtgccaagaacagcacaaatgtttgattgggctggcctgaagaactttactgtatagtaacaacattcactactctaaggacctagagcatggtagagttatgtccacttgaatgttatgacaggagaagggattaacgacatttatttgcctggtattaagaccctaaattataagcagccccattccaacacacacacacacacacacacacacacacacacacacacacaatctgacttttgtttattttgaaccccttttacaatgcctacctatttaaccatctgatttgctttgcgtgacataggggcatagagtgagctaggtaggtttctgaaccctatgctttgactatacttagttaatctcttacctgaatgaaagccttaggtttctcatctgtgtaatataaataaaaacacttaccttgtatgattattttgttttgaagtttaaatgagaaatagatgttctaaaaattactgatatgatactttcttagcaagcattaatcttcccccttccttacatttctcagagttatgttgtgaggattcagtgaactaatgtgatatatcatgagaggtgaagagcatagaatttgaatcagatctgaattcaaatcttggccctgctacttatcaactgtgtgacactggggtattatttcatcttttaaaatatttttgtttttaaattttaaaatgggaataatgatcctagttcatgcagtttttgtgaggataatgtaaaatgcatatacatttccctgggctagacctggtgttttccatacattactaagctattattaaaacactaccccagttactatctgtagtctgatttatgttcagcttctttgaagatatcttccaaactagatcatgagtttctggagtgttaggaggcggatttgactctgttgaagtctgaagaaccattggagtagtgctaagtgcattatgctcatgtctgttcaacttttggccagtagaataaatgcttggggttttctacctacttagctatcagtcactatccttccgatggccaataggagcaaaaggtttgggtaaattattaatgtaaagaaagctgaatcaaattcctaggttgtctaagtataatatcccagcaattgtattgggtgactagaaacttataaatgattagtgacaaaaatttggctcaattttgtataatatttatcaatttatctcatacataggctatatctactgtattactttaaaaaaaatgtatgtttgtgtgtggtctactatgatgtcatgtaatgcatgcccctgacatgtactgaatgctccctaatgacttcatgatgactagttttaaggaagaaaataaaatttaaaaaaggaagtgagcataagcaaagagggaagaaaggaaagtgatcaggatgaggagatggtgaatacaaccagagactggcctggtcattgctttcctaaccttcatatatggatctcttagtatcattatacagttttgtttaaaaatattatttttgtaaaagcatcatagctgttatttatttatttttgagacggagtttcgctcttattgtccaggctggagtgcaatggtgtgatctcagggtcaccgcaacctccgcctcccgggttcaagcaattctcctgcctcagcctcccaagtagctgggattacaggcatgcaccaccacacctggctaattttgtatgttttttagtagagacggggcttctccgtgttggtcaggctggtctcgaactcctgacctcaggcaattaaactactaaaattaagtatttgagagcatgaaagataatttaaaaagcatgtactgtaaaccaaccaaaaacagataatcttggaaataaatttttccttagtattctttaaaataataaaatatactgcaaaattttcaagcatttccaaatcttactttgtcatgcaatacttgcttatgcagcagtgaccttgttgatgctatgtacaatctgtcattttatggattatccctactaggtagatgttaaccacttcttgacaagaaaggcaggacacagaaagttgaatggtttgtcttggtttctcacaaaataagaaataatcagaatgagatttttatggtgtgggctctcctgcctgatttattattttgaactttttatgtggttctgtctatggagaaattgaaaagtaaacagatttagggactgattgctgtatatacattgttttcagaccataggagagacaaacttccagttccagttatttctgtttaacatttctctgcaaatcagcaaggcttgttttatccaggcttggccaagttaaatatattccctgtatttttcccttatgtttggatatctagcaaaatattcctcattatactgtttattgaagtgaaaacttgtatgtgattgtatgaatgcctaatagtcttgaagtaaaggccatcaaattcaataatgcctggagagattgcatgtattcttctctaccacatatttatagcatttgtttggagtgccaaaatttttgttttagttctatagataagaatttctcaaaattttttaagatttttcaatttctcctaaacataatacataaggaacactttttggataaatgctgtgtaaagttagcaaacaaaaacaaaaacaaaaacattattttcttttaccgtgtcccctgatctcaaatcttttcatttctctgtttgtttgttttaaatgtaattttagagggctgctgaagtatcaaactaatttagatacccaccctcccggctgcatcagtcttaaccgaaccagctctcagaatatttccttaccagagtatttctcagaacattttcatgaacctttccctgaaggattttcaaaaccggcagagtttacccagcacaaatttgtgaagatttgtatggaagagcccagattccaagctaattttccacaggtcagattaattttgtgtttgatctccacaaagtttgtttccatttgactgatcaacatcacatataaatgtgtttttcaagctatatattcatgcataataggatatttcaggatgtttcaacagtaagttagtacctattattccattacaggtacctgagagttcaatgcaaaaggtctatgatattagaggatatataacatttctacttaactgaccatatgacctttgcatacaacagcattggtgcttgcagccaagagatgacaaatattttttcccatcatttgagaaaagctgattgaataataaaaatagtagttaaaaaaacctaccaccaataccacaaattattattttattgtattatattattatgtataatattgtaaatagtaaatagcaaaatcaatttattgaatgcttaatattatctgccaggcattgtgctaaaatgtcctgtatgcctaatacagaacacttattagacatacagaatgtttcttgcaatattcgcaatgactatttgaagtaattaatatcaccctcgattttctgataaagaaattgtacttaccttgatcaaaatctccaaaccagtaagtggcagaggaagcatgtaaacccaggtctttgactaatatgcttgctcctggtaaacgtccataagtattcagcgattagttcaataagggcccttatcttcctctgtgcctgtgagaactgcccccgtgcaaattacaccttttattcctcacctataaaaagtggaagtaggaaatagtgatgtcaaatgtctctattggaagagaagaaagagaagtcaaaagctagaatgaatttgtagatgactttggaatagtgtattagtcgtgtttattattattaataataatcctctagatccctattagcctctataattttcagaacttttctgagtttcacataatattcacaaatattagggcaggtatggcgactcccattttgctcatgtgggacctgacactcaaagagtaagtgattgtctcaaaggtgcaaggctgctacattgcagaccttgtcttgtagtgctactcataacacagtgtggggctaaatgttattatatgcagaagaggcatggtctgtctgcatgaaagaaggaagatttgaaacaactaaagtgaggctttaaaaagtgaccattaagacaagttttagttggaggcctcaaagggatgtgaaagataaagtgtgtaattttaggagaacagtaagccacataggcttctgcacttcccaaagtttgcatgtgtcctgggatcagggctaaccatgcaacacatattcaaaactgtcatggtttccaaattataaatattattttatgttcttattatattatataaaagtaagtggtaaacaacatgcctagcatattgcatctttaaacatatgtgctatacatatttaacatatatatatatacatattatatgtatgtatattatgcatatacattatgtacattaaaaatctagggttttcttatttaataaacattagactgttaccttatttctaaaattatccccagatttatcggagattgttaactcccctttattcttttattaaatatattgtgtatatacattacatatctgtaggcatagaaaggtgtatgaaagaatatatacttgtttgctcatggatagttacacccagggcatgagattgagggtagggtcttgatattactttctgttttattttatacttttgtttgtttgaatgatagtgagcatctattattttttactcatttgttatgttttcttatttaaaatacaaattaaaatactattactgtaatgtatgcaataagcaattgggcagggtgtagatttctacaatatgagtatttcttgaagtatattttcaaaaatttgtcttagacttggctttggatttctggacctttgtgcctgtactgtgccgaaagactttacaggtatatccggagcaataagccagtcaccatcatttcggtcataagtcatccctcagatgtcatggaaatccgaatggtcaaagaaaattttaaagcaagacctggtcaggtgagtcagtggtcagcaactttttaaatagcctttatccttatgtaatttttggaatttagcaaacatagcatcattgaaatagttgaaattcttaattggtcatttaaaacttatctgtttgttgctttttagtatattactctacattgtcccagtgtatctgcattagaaaatcatccatttaccctcacaatggtaagaaacatatctcttgctttttcacatttgtagggtgctatgcatatttttctttttttgtgtcctgtctcattctaaaaggtattcaaggctatcatagtactcttgatgtttaagtaagctatctttttacaaggaaaatagttatctgctcaagaactgtgtaactacactttattattttttgacaccttgcaattcaggaagtaatgaattaaaacgtattaaagcttgttgattcaaaatataggccaagcacagtgactcaggcctgtaatcccagcacttttggaggtcaaggtaggaagaccacttgagccccggatttcaagatcagcctgagaaacataaggagacactgtttctacagtaaataaaaaaaaaaagccagatgtggtggtacacatctgtagtcccagctactaggaaggctgaggcaggaggattgcttgagccccagtgtttgaagtttcattgagccttgatcccaccactgctctccagcctgagcaagagagtgagaccttgtctcaaaaaacaaatatatatatatatatatatatatatatatatatatatatttaatttcttgaatatttacttttctccttttatggagtattttaatgtatatggaaatcttatatatgcacaattttctttggagatggaatttaggggaaatacggatactctgggttgaggtggaaacattaaacaaaacaggcagtgtttagaaaaggtaaaatccagtgtaatgggagagagaatggaaataaaattagaaaaatcaaatggagtaaataatggcatgggagggcatctagctaaataatggacaccatcaaatatgattagctagtcagcatatcatttaatattattataattataaaaatagcatgagttcattataaacatttagacaattcacagatataaaataaaatacaaacttaaaaaaatttttccccactttccaatccttttctctactgtttgacatatgtctttccagatattttcccatatgcttctgcatacatgagtttctaacatttatttgctggatcatattgttttgtaactggctcctttcactcaactacatgtgatggacatctttccatattactgtatgtgcctcattcatgttaatgaccatataatatttcacagtaggaaagtactgtaatttatttaatattctcattgaagttggatatttggactttattcattttctaagaaagataattgagaacagagaccacatgtttaaatgtatacttaagaaagatagcaaaactattttatatatatggtatgtatacatgcagacagatgggaacatgttgtaaagcatgttgtaaaacatgttcccatctgtctgcatctatacatcccatatacatgaaattggtaacatgaaaatagaagggaataattgaaaagggagaaaatacacaagtaagtttgtctttacttaaataacttaagaagttttgcctaatcctgagttcataagaaatttacttcagattgccctggccagaacttccaacactatggtgaataggagcggtgagagagggcatcactgtcttgtgccagttttcaaagggaatgcttccagtttttgcccattcagtatgatattggctgtgggtttgttataaatagctcttattattttgagatacgttccatcaatatctagtttattgagaatttttagcatgaagggctgctgaattttgttgaaggccttttctgcatctattgagataatcaagtggtttttgtctttggttctgtttatgtgatggattacatttgttgatttgcatatgttgaaccagccttgcatcccagggattaagccaacttgatctcggtggataagttttttgatgtgctgttggattcggtttgccagtattttattgaggatatttgcatcaatgttcatcagggatattggtctacaattctctttatttgttgtgtctctaccgggctttggtatcaggatggtgctggcctcataaaatgagttagggaggattccctctttttctattgattggaatagtttcagaaggaatggtaccagctcctctttgtacctctggtagaatttggctgtgaatctgtctgatcctagacttttttttggttgggaagctgttaattactgcctcaatttcagagcctgttattggtcttttcagggattcaacttcttcctggtttagtctcgggagggtgtatgtgtcgaggaatttatctatttcttctagattttctagtttatttgtgtagaggtgtttatagcattctttgatggtagtttgtatttctgtgggatcagtggtcatatcccttttattatttttattacatctatttgattcttctctcttttcttcattattcttgctagcagtctatcaattttgttgatcttttcaaaaaaccagcttctgcattcattgattttttgaagtgttttttgtgtctctctctgcttcagttcagctctgatcttagttatttcttgccttctgctagcttttgtattcgtttgctcttgcttctctagttcatttaattgtgatattagggtgccaattttagacctttcctcctttctcttgtgggcatttagtgctataaagttctctctacacactgctttaaatgtgtcccagagattctggtatattgtgtctttgttctcattggtttcaaagaacatctttatttctgccttcatttcattatttacccagtagtcattcaggagcagtttgttcagtttccatgtagttgagcagttttgagtgagtttcttaatcctgagttctaacttgattgcactgtggtctgagagacagtttgttgtgatttctcttcttatacatttcctgaggagtgctttacttccagctatgtggtcaattttggaataagtgtaatgtggtgctgagaagaatgtatatgctgttgaattggggtggagagttctgtagatatctattaggtccgcttggggcagagctgagttcaagtcaaggatatccttgttaaccttctgtctcattgatctgtctaatattgaaagtggggtgttaaagtctcccactattattgagtgggagtctaagtctctttgtaggtttctaaggacttgctttatgaatctgggtgctcctgtattggatgcatgtatatttaggatagttagctcttcttgctgaattgatccctttaccattatgtaatggccttctttgtctcttttgatctttgttggtttaaagtctgttttatcagagactaggattgcaatccctgcttttttttgttttccatttgcttggtagatcttcctccctccctttattttgagcctatgtgcatctctgcacgtgagatgggtttcctgaatacagcacacagataggtcttgactctttatccaatttgccagtctgtgtctcttaattggggcacttaaagggtattcagttaggaaaagaggaagtcaaattttccctgtttgcagataacatgattgtatatttagaaaaccccatcgtctcagcccaaaatctccttaagctgataagcaacttcagcgaagtctcaggatacaaaatcaatgtgcaaaaatcataaacattcctatacaccaataacagacaaacagagagccaaatcatgagtgaactcccattcacaattgcttcaaagagaataaaatacctaggaatccaacttacaagggatctgaaggacctcttcaaggagaactacaaaccactgctcaacaaaataaaagaggacacaaacaaatggaagaacatttcatgctcatggacaggaagaatcaatatcatgaaaatagccacacttcccatggtaatttatagattcaatgccatccccatcaagctacctatgactttcttcacagaattggaaaaaactactttaaagttcctatggaaccataaaagagcctgtattgccaagacaatcctaagccaaaagaacaaagctggaggcctcatgctacctgacttcaaactatgctacaaggctacagtaaccaaaacagcatggtactgctaccaaaacagagatatagaccaatggaacagaacagagccctcagaaataacaccgcacatctacaaccatgtgatctttggcaaacttgacaaaaacaagcaatggggaaaggattccctatttaataaatggagctgggaaaattggctagttgtatgtagaaagctgaaactggatcccttccttacaccttatacaaaaattaattcaagatgtattgaagacttaaatgttagacctaaaaccataaaatccctagaagaaaacctaggcaataccattcaggacataggcatgggcaaggacttcatgactaaaacagcaaaagccaaagcaaaaaaagccaaaataggcaaatgggatctaattaaactaaagagcttctgcacagcaaaagaaactaccatcagagtgaacaggcaacctacagaatgggagaaaatttttgcaatctaccaatctggcaaagagctaatatccagaatctacaaagaacttagacacatttacaagaaaaaagcaaacaaccccatcataaagtgggcaaagaatatgaacagacacttctcaaaagaagacatttatgcagccaacagacacatgaaaaaatgctcattattactggccatcacagaaatgcaaatcaaaaccacaatgagataccatctcacaccagttagaatgatgatcattaaaaagtcaggaaacaacagatgctggagaggatgtggagaaataggaatgcttttacagtgctgctggaagtgtaaactagttcaaccattgtgggagacagtgtggcgattcctcagggatctagaactagaaacaccatttgaccctgtgatcccattactgggtatatacccaaaggattacaaatcatgctactataaagacacatgcacacgtatgtttattgcggcactattcacaatagcaaagacttggaaccaacccaaatgtccatcaatgatagagtggattaagaatatgtggcacatatacaccatggaatgctatgcagccataaaaacagatgagttcatgtcctttgtagggccatggatgaagctggaaaccatcattctgagcaaactatcacaaggacagagaagcaaacaccacatgttctcactcataggtgggaattgaagaatgagaacacttgtacacagggcggggaacatcacaaaccagggcctgtcatggggtggggggctaggggagggatagcgttaggagaaatacctaatgtaaatgacgagtttatgggtgcagcaaaccaacgtggcacatgtatacatatgtaacaaacctgcacgttgtgcacgtgtaccctagaacttaaaatataataataataaaaaaattacttcagaaattaaccttcccttgtgttggcaactttattttgaaaatcatttcttcaccataacattaaataggaaatatggaataagaaaagaaatcagttgctgagtgtcaagtacagagcagcaagagtttttttgttgttgttttttaaactatttttcaacataaacaaaagtagagagaatagtataatgaatccttgtattcataaaaaatatagaggttagtttactttttagtatatactcaatcactgaaaacttttttactttcttaaaacagtgtatcaaagaatttttcacctatgttcacactgaagagaggcttctagatcaatttctttcagcaggcctaggcccttttcacaaggcaaagggaaaacacaaaagaagtagtgtgtagagctggaagggctttaagtaagtcccttctatggcctggcctgcttcttaagatgtgattatggtaacagatgtgatagccctgtggccagcttgaggcaaagatgggaagaaaaggaagaggagagaagtgaatgtaggtacagacagaagaaaaggaactggaggtagaagacggctgagaaaggaaaattgaattatatgtgaaataaaatagtagtaactattcagacaaagggcaaggattttagaactcaattccagatccctcacttgttacttctgtgtctgtgaatgtatctctcaaccttgctaaggctcagtttcatcatctgcaaaacagtgctagtgatacttacctggaagggcatctttgatattgtcaatattagtttataaaataatgtgtataaaacccttggcacatcattagtggtcaatacttggtaatacagatattattattactttcataatcttaaaatacctggttttaacttggattattgctttcatttctgaaattatgctttttttgagaagcaagtacaagacatgagcatgtggcttttcaacttgaaaatgagaaacgggaatatgaaagtagtctcaggtactgaaaatctgtcgtgtgggtgaaagatttgattttttttttcctttgggatcccaataggcagaaagttttaggaaaatacatttttatttaacataataaagacatttctaacaatgagaccagtctagaaattacaaagagctatctcacagaagtgtttgcaaggattattgcactagatcaggatttttcaatcatggcagtattgacatattggatcagacaattcttcgataggatgtgttgttctgtgtattataggatgttttgcagcatctttagccctgacccactagaagccaatagtatcccccactgtgacttccaaaagtgtctccaaatgtagccagatgccttttgaggggcaaaatcacctacagttgacaaccaccgcattagatcgatagttgtccaacatagcttccagtgctaaaggtcttcagcactttagaggccactgtgagaaaggagaatttaagcacaatagagaatttgagggatgggagtgcttatcttttgttctggggacaccgatcatgtcagtgagaacagctcacttccaaatggtctctgttatgaggattctgctaaagtactcatataaacatcatcatctaaaaacatattttgcttactcaacttgaatcctttttggaattccatgaaaattattttggttaccatgagctcctgaatactttcatgtcatgtagacctttgaaagagaatttgattacttttaaaattcagaattcttttttttcatattcactgtcatcaatgcccaaataacagtttggatatgaatcaaaaggaaaagtgggatagcagtataaaactctaacacgttcatcaataattaaaatgacatgaggatagcctcatgtacttgatatttttgtcatataaatgaaaggtttgttctttccccctgtggaatctcgaagtgtggaaataagaacagtacattgttcttggagaacaaatactggtttagtgaccactttgggaaataatgtgtttgggttggtgaaaaaagacaagagagcttttcctcacctcacggaagctccattagttatatgaggctctggagcctccctatgggttgcctcctacagcaaaggacatctcaccccgggccttcactcttgaggtggcccagggagccctcagtatgaaggctctgagtccattgcaggcttgtttcagaagattcaggttcagaagtgcaagagatgaagataaagaggttgggtgtgtacagtctatatccatcatagtttttcttttcttactttttcatttaagaaaaaaaattgtcttatttcttctggttctgtaagaatattttaccaaaatgacagagaggagaaaaaaggataattgtagtaaagcaggttattggagaccacttcttccattcttttaaagaaagattgttctctggaaattatcccaggtcgggagagggggcacaggaggaaggaaggaaggaaagaaggaaggaaggaaggaaggaaggagaaggggaaggggaaggggaaggggaagggaaaaggaaaaaggaaggagagaatgaaataaaatacatttttcaatggcctagtttggaaaatgctgattaatatgtattttaaagtgcatagtgcctactaatgtattaatggttttgaggagttctttaatatataatctcattaattttttttctttctttctttttttttttttttttgagacaaggtctgcctctgtcacccaggctgggcagcagtggtgtgatcatggctcactccaacttggacacctgggtttagcctcctgagtagttgggactacaggcacatggcaccatgcctggctaaactttttaaaaaattgtgtagagatagggcctcgctatgttgcccaggctaatctcaacctcctagcctcaaacaatactcctgcctcagcctcccaaagtgctgggattacaggcatgagccaccccatgccgccaatcccattaaattttgttcactcatttagttaatgctttctcattttcccacttttgggtctcaccctgggaaacaacctcattttcttccatgtattcacaccttaaactccacccattctctttgtctgggaactcttactcatccttcacatctcatcttcatatcacttctgctgaggagccttcactgacccttccctattagattaagtttcctgacctttccttttatgagcatcccatgtacactcttcaacaccagtcattaaattatttgtttaattaatatctgttctcctcatagaccataagctccatgagccctttgaaagatgaattcatagcacagtatgtggtgcataatcaatgcatatctgttgaaagagtaaaaaccacctaatatatagagttcaggacctagcttgagaaatgctttgtagacagagcctccttcccccatctctttatagcacagtcttccttagagggtgcaactacagaaaaggaaatgttggagggataaagaagaaaggagaaatatttatttccaaagtggctctcatttggagtagactgagtcagaatagagtatttaattaaagtctaatatttgagatcatggtgcttatttctctctaacaaaagaggaggggaaaatgtacctatggcaaaggtctttagaaagaaccaccaaagacaaatagacgcaatttgtggattatatctggtctatgatgaagtcatttttcacctcacctcccttattctcagcacaaataataacagaaaattacttgctcctaattctgtgcttatctgacaaatgccgtcaatatttcttggattcatctagcaccttgtaggctgaagtagaacttgactctacaaggttaggttttgcattcacattcattcatattttaaacatcagtttctgtatgttttacttatgctttattaaatctcaattataaatactaactgttttcttaaaaccactctatctcatagatattttaaattgttacaatagttggctttaaataaaattttaaggcaaagaaattatttttatcagaccatctgtttatcatgtaggcttaggaagtggtttatagcttccccagatttggggggttacaagctcgctcatttgtactatcccccaagggagtttttgttttcataagtggaaaataggcaaacttgctgctacctagaaatgaatttgagtagggcaaatatttctaagctaaattttacattatgctattatgctaatttacagtctcttcctgccatttccttctctgtccaattacttctatttggcacttagaaatgtaaaatgcatgctttcaaacattttcactgcatagttgtcttaagagttcccttgaagtaaaacaaagcaatttcccatatggtgattcccactaaacagtgagtatcacatctttgtcaaagataatagtacctactaattaagtgcctaagaggttctttcatagcttttgcaaatattatattatttaattcttattatattcctatgagacacgtattgttaactcggtgacacagaaaagaatgtggctcagagagactaaatagcatgcccaaagtcacacatttagttgaggtagaggtgagatacaaacacagacctgtctggctgaaggcatgttattaactgttctgcactgtctctctcctgccacactatccttccatgctgagggctttcatattgctaacactgctcttacttttggacatctatgttgctggagtcagaaaacaaaaataagtaaaattaccatttcgaactgaggtttattgaaagcacaaatatgtgttttctatagtaatgtgaaagctttcgattgtccatactactaagctcttctaatattgtgaagtggtgaaatttgaataaatccccctgtttttaaaaagtctaatacttattttcatatactgtgccagttagaaacaatcaaatcaataatatatacagctattacaaattcagtagtttgagttttagctcactttttaagatggagattaagcttttcatactgaaagtataacttcaaagtacaaaagacagggcacagaaatactattttggtcaaggtaaagctaagctttaagcacgaatttattaggagggcaaaggttggagttttgattatttaaaatgcttcactatttttcatacatgtcattgacttccctacacaagaaggatatcctgatttgatgggttttccaaggaaattgtgattgtttcttgctgtggtacacctatattttctcatggtaaaatctcacacacatgtttgctgacaagattgatggaaattataggaccttatgtagtatcagatcatggattttggaataccacagcttgggatggagacctgtatgctctacttcctagtattatgactgtggacatgaaaattaacataatcttttgtttacttctttataaaagtgcagttaatgatagcaacttctccatggagttactctgaatattaatccaaaacatataattaagtggtatgtgtggtgcttggaatatagtaaactctccataagtggatttagttatggttgtttcagatagtgactaagggaccaaagacatggattaaattaagattttttgcctcgttcttcagtatgtagtaactgactaagctttggccacagattggtgtagaaacagtcatttgaggggaactgatgacttatttgccttttatggtcttctagccttaaggatgaatgacgttttaggttaggtttccttgaaaacaggctggcaggcatattgcatgcagcagatttgttgggaaggatgcttaggacaacagtcaataacgattgactaaaaaggcaaggcagaacttgaactatgtgatacaggtccatagaggtctcagaagatctgacaggagctctgcagatgaaatgatagcttatagtgtcctgtcttgaagtcagggggccaaatctttgtaacccccaactgaccagtcattggatttgagatacctccatggtgaggcacttagacataggcaaggaagctttgttctgtggattcctggggcaggtctcagtggtgagccctcccaggcaaccttttcagaagctggaagaatggtgaatgagtgtgttgatcctggaagttgggcagaggttgggaagggaaagggtctgagcagtgcagcacagtgtccattaagtagcttttaaaaacatagatcgtttatgagataattctccatttttaaaactagaaattaaatttgaggtacatataaactctagtttatctatactaattgaactttaaaaatctgttgtccaaactacaaatttatttacatttgagaagtctaaagcatagactgttgaagtgaccaaagtaatcaaaataatacaatcaatagctggaacccatttgttgactcttctcctgctttacacctttattgatttaaaacctgtgtagaatgtaacgttttgttcttcaagtatgtaatggatgtctgcaagtattttccagctgtgctctgtgattaccaaatttaagactttctaccaaatcaaatcctttattaaggtgtgctctcacctaatttacctgtataaattagagatgattggaaaaagccctaacgtaagagagcaagaaacctagtgcttcctacaaaatgtagcatcttttcatatttagctgaggtagacattattttcatactaatttcatggattctcaattatggaaataatgcagaatctgccttttaaatagaagtaatgaatcgatgtttacatgaatacctctttattcttctgttattatttttattcaggaacaaactgtcacatgcgtccctgtgaagagaccaccaaacaggctttgtgtgagcaataaagctttttaatcacctgggtacaggcaggctgagtctgaaaagagagtcagtgaagggagacaggggtggggccattttataggatttgtgtaggtaatggaaaattacagtcaaaggtggttgttctctggcgggcaggggtgggggtcacaaggtgctcagtgggggagcttctgagccaggagaaggaatttcacaaggtaatatcatcagttaaagcaggaaccggccattttcacttagtctgtgactcttcagttacttcaggccatctggatgtatacatgcagtcttgggctgagaggcctgacattcctgtcttcttatattaataagaaaaataaaacaaaatagtggtaaagtgttggggtggcgaaaatttttgggggtggtatggagagataatcggcgatgtttctcagggctgcttcaagcaggattaggggtggcatgggaatctagagtgggagagattaagctgaaagaagattttgtggtaaggggtgatattgtgggattgttagaagaaacatttgtcgtataaaatgattggtgagggcctggatatggttttgtattaattgagaaactaaacagaagacacaaggtccaaataagagaaggagaaaaacaagtattaaaggactaagaattgggaggacccaggacatccaattagagagtgtccaagggggttcagcataattacttgcttggttggagagtttttggggctctatccttgagtttttttatgttgtcatacagcaggccagattgatttaggtaaaaacaacactcttcatttaaaaatagagtcctctttttttagcagtgagtaagtcgaggcctccacgattttggaggaaagagaaatgcaaagccagcaattgtttaagaaggattagaaatggctaggagagagtgagggagattgatggtgtggtggggatagttggggagaggtagagtgtggcataagaatgggaacaagaataacagtgcgtataaaagtaaagaataggacttcatcagggtgaaagttttggagggtaccctgtcagcaaagatcatctatcctctttaagagagaattaagggtggcagtttgaggtaaaaccaggagatatcagttatgatggtttgaaggaaaagtgtaaactggcagtgtaaacaagggcaggatatttatgagtagttgagaatgatgaataggagtttgactagacagaagatagtagggatgacaagtttttggggtgcggttcaagttgggctggtgtctagaatgagactggggcctaataaaaaggagcatccatacaggagctcaaataggctataccctgtagcatcctgaggacaggccagaattctgagaagggcaagtggtaaaagtattgtccattcctttttaagttggaggctgagcttgatgatttgtgtttttaaaagaccattagtccattttacctttcctgaagattgaggacagtaaggggtatgaaggttccactgaataccaagagcctgagaaactgcttgggtgatttgactaataaaggccggtccattattggactatgtagaggtgggaaggccaaaccaaggaattatgtctgacggaagggaagaaatgaccatggttaccttctcagaccctgtgggaaaggcctctatccatccaatgaaagtgtctacccagaccaagaggtattttagtttcctgactcgggtcatgtgagtaaagtcaatttgccagtcctggtcaggggcaaattctcgagcttgacttgtagggaagggagggggcctgaaaaatccctgaggagtagtggaatagcagatggaacactaagaattgatttccttgaggatagatttccatggtggaaagaaaatgagaggttttaagaggcaggctaccagcttgtaacctacatgaaagacgttatgaaatgacaacagaatagaatgagcctatgaggctggaaggagatccttggtccaagaacaatttgccttgtttgggaagagattgatagttggaagtttcagtgggggagtaggtgggagtgactgatgagaaggagaaaaacttccatgaggaacagaagttggaatgctagctgcttttttagctaccttaacagcataagcattaccctgagggatgggatctgatgccttttgatgacccttgcagtgaatgactccagcttcctttggaagtaaagtggccttgagaagtgtttttattaaagaggcattaatgatggaggaaccttgcatagtgaggaaacttatttctgcccatataacagcatggtggtgcaggatatggaaggcatatttagagtcagtataaatattgatgcatagtcactttgcaagagtgagggctccagttaaggtaatgagtttggcttgctgagaggtagtggaggggacagagcggtagcctcaaggatagatgtggaagatactatagcatagcctgcctttgctaatgagtggcaattaggcctggtggaactgccatcgataaaccaagtgtgatcagcgtgaggaagaggaaagaagaaaatatggggaaatggagtgaatgtcaggtggatcagagagatacagtcatgggggtcaggtgtggtatctgaaataatgcgggggccagcctaaaacagtaaggtcaagttgtttggacagaaaggctacagggtgcggtcccagctcttgtgtaagaattctgactgcacagccctgtactttggctgtgtgtaatgaaaaatggttgggatgagttagggagagctagtgtgggagcagctttagggatgttttttaaggaatggaaaggggagtggagaaaggatttaggatctatggggtcacctagatttgctttggtgagtttatataatggtttagtcaggatggtaaaagtaggtatccaaaggcagaagtagccaaccatgcctaggaaggaaaggagttgttgttttgtagaagtggttggggtttgggagattagccagacatgatcagctgggagagcatgtgtgttttcatgaagaattatgctgagataggtaatggatgaggaagaaatttaggcttgacggaagtaatgggggctgtccgtgaagccttgtggcagtacagcccaggtaatttgctgagcctgatgggtgtcagggtcagtccaagtgaaaacgaagagaggctgggatgaagggtgcaaaggaatagtaaagaaagcatgtttgagatccaaaacagaataatgggttgtagaggggttgtggagggaggtattgcagataggagagtatatgggtttggcaccatggggtggataggcaaaacaatttggttgataacgcacagatcctgaactaacttgtaagacttgtctggtttttggacaggtaaaatggggaattgtaaggagagtttataggctttaaaaggccatgctgtaacaggcgagtgattacaggccttaatccttttaaagcctgctgtgggatgggatattggtgttgagtgggttaaaggtgattaggttttaatgggatggtaaggggtgcatgatcagtccccaaggagggagtagagttatcctatacttgtggattaaggtggagagatacaaggggaggatgtaaaggaggctttgaactggagaaaagggtggcagtgaggtgtggctatagcctaggaatagtcagggaagcagataatttagtaaaaatgtctcatcctaataagggagctgggcaggtggggataacttaaaaggagtgcataaaagaatgttgtccaagttggcatcagagttggggagttttaagaggtttcgaagcctggctgtcaatacccacaacagttatggaggcaagggaaacatgcccttgaaaagaaggtaatgtggagtgggtagcctccgtattgattaagaaggggatggacttactttccactgtaagagttacccaaagtgtctgtgatggtccaggaggcttcagaggcgatcgggcagcattagtcttcagtcactaagccgagaagacctgggaaggagtcagtcagagggccttgggccagagttccaggggctctgggagtagctgctgggcaagttggacagtttgatttccaacggggtcccgcatagatgggacatggcttaggaggaatcctgggctgcaggcattccttggcccagtggccagatttctggcacttgaagcaagatcctgagggaggaggtccttaaggaatcccagaccgctgtggcttaggcgttttgaagttcttgtgtgctgcaaatgtggctggggtttctcttacagcacaggcaagtaattgcaactcctctgttattgaacatcttgaaggcgaggttgattaattcctgttgtggggtttcagggcccgattctaatttttgaagcttttttttaatgttaggagctgactgggtgataaaatgcatattgagaataagatgaccttctggcccctctgggtctagggcggtaaagggtctaagaattgtggccaaatgggccatgaactgggctgggtttttatatttgatgaaaaagagcctaaatgctaactgatttgggagaggttggataaagaaaaaggagcattaaccttgactatgcctttagctccagccacctttttaagaggaaattattgggcaggtgggggagggctagtcacagaacgaaactgtaagccagactgggtgtgagcaggggaggtgacagaagaattatagggtgggggagtggagtctgaggaagatttggagcctgattcagcctggcagggagtgacctgaggaggagcagtcttgggaggaggggagaagtcagatgggtcggtagaaaaggaagattgaaaagactcagcaacacttggggttgggactgaggggacaggtgggagggaaggaaggatttgggatgagtcgcattgggaacagagactagggagggaccaatgtgtaaaagaatgcctggatgtcaggcacctcagaccatttgcccattttacgacaaaaattatctagatcttgtacaatggagaaattgagagtgttttctggctatttggaactattgtcgagtttgtattggggtcaagtggcattgcagaagaaaataaggcatttaggttttaggtcaggtgtgagttgaagaggctttaagttcttggaacacaggccaagggagaagaaggaggaatgaagggtggaaggttgcccatagtgaagaaggcaagcccagagaaaagaaagggtagggacacggagagaaggggtggggggtacctgccctcccccctcaggaaagtggtacttgccactaaggtgaaggatcaaggcaggagtccctgcggtgatcagacacctctgaaacgtgggtgaataatcaggcaggtgtccccacagtgattaaacaccaagggaaaactgtcttgccgagtccgtgactggtgccggagttttgggttcacggataaaatgcatctcttctgtctctaccagaaaaggaaaggaacagaaattaagagaagagagagacccaagggtggcaccaagattgaaaggagaaagaggttgaaggatagtgagagaggctggagaagagtaaaaagagcctgcttacccgatttaaaattggtgatgttccttgggctggttggtctgaggaccagaggttgtaggtggatctttctcatggagcaaagagcaggaggacaggggattgatctcccaagggaggtccccccgatccaaatcacagcaccaaatttcactcatgtcagcgtgaaaagaccaccaaacaggctttgcttaagctaagcaataaagctttttaatcacctgggtgcagatgggctgagtctgaaaagagagccaaggtagggagataggtttgggtccattttataggatttgtgtaggtaatggaaaattacagttaaagggggttgttctctggcaggcagggatgggggtcacaaagtgctcagtgggggagcttttgggccaggagaaggaatttcacaaggtaatgtcatcaaaggcaggaaccggccattttctcttcttttgtgactcttcagttacttcaggccatctggatgtatacgtgcaggcttgggctcggaggcctgacacaaacatgctttcctgacatctgtattctaacttgtgtgattcattgtttttaagcttgaataacctgatttcacatatttttccatgagtcagaggcatgtctagctgttagtttgttattgtctgtacttttacatagcatgcctgcactagccatcatttttctactttgtgtttttaatcttttaaccagtcactttgggaagagtttttccaggaatagtttttcccgttttcaaagaaaaccaggcaagaatggctatggatctcacaaagactggcaacattttgttgctattgtttatttaatttagtgggtttaaatgaaaccaggacatctgcagcagttttgatctctggtcttgctctcaactatttaaatcttaaaaattgttttgctctatgttttcataattttattgcttgtcaaaaatcagctgggatacatgataggttagcatggtgacaatgttatcttaaccatagatgaagcaaagtggtgaaaatttcctgagaagatgattaatgttcatgaaaaattaataggacatctgagtttcttgagatgtaaacatcatctaactgctctagtttggcttttttccaagggaaataaaaatattcccttagtgtctaataagagtctacatgataagtatgaactttagaaggttagtgtatttagggtaaatctattgaatattgagcttaatttattcaatccttatttttgggtgcctgtttttacctaagtaccaaaaggaaatgatcaatgaaagtttctttcctgactcacatcccttctagctactgctccctctctcagcaatccagttcctttcctctcattctcttaaatcaaccatcttttgattgttgatttaagcacactactaaaaatgtccaggttcagcagtgaccatgttattgttcagttctcactcttcaatgggtttgaccaataagcagctcttaatacagctgatcattcactttactgaaacacttttttccacttacctgtttttctccacattttctggctatttttactcagtctatttttgttgttccttatcatccccacaagctctaagtattacaacataccagtgttcatttcttcaacctctctttctctctagctgtacacatttctctggtagtctctctcatcttgttgatacatccatatgcttcatgtcccaagtttatattcctagcccagattttaactctgtaattcaggctcatatatccagaacatttaggcctttggcttttactttgattgataaaggagttgtgggagagtgtgaatggagaaatgacatgatatggcttacttttcaacaggatcactctggctgctgtgttaagagtagatgaggggaagcaagtgcagaaacagggggtccagttaggagctgttgcagtcatctagtcgaagtatgatgatgattttgaccagggtggtgatagtggaaatggtgagaagtggtcatattctgaatatattttaaagttagagttaacaaaatgtattccatggattgtatataatgtgaaaggaagtgaagtcaaggctgaccccagagtttttggtccgagcaactggaatttcattaactgagatagggaaggttggggttggagaggaggttctgatggaaatttgtgcaactccacttaggaagtgttattttgagatgacacttagagtgctttcattaaatatttattgagcaaatgactggcatctcagccctgccttccacgaccagttatttctatacatagaggctttgtgtttcacgtctccttgtctttgggtttgtggagtagtagttacatggctggtgatcagagcaaagtgaatctggggataaaattaccccatatacagacacaaacagatttttttttttttaatgatgagccccaactctaacttcctcctattacactgagacctgggtttttccagtgttgtgatcaaaagatgggcttacttctcaaggtaatctctgtttgaaggcaatgagactttggtttcatatgttttgtttagtcagttcctaaatggctacctcatccacttgtcacttttcaaaaatgtgttgacatctctttattattcttatcactccccatgttatttttgccattgtggcatctatttttatatctctaaattgttattttagtattctgtttgcctaagggacctgagataaatgcacacgttcaatccaagttaataaaaattccacttgcatattcttccagaatctttctttttaatattgaatatatttttcattcaaatatacaattaaacacttttttctttcatacaaatgcaaaagcattaaagttttaatttgtcaaaatgtttactgtcatgatgttgcattaattgtgggagattcggtgctccgcgtgatctcctctcagacatttagagcaatcttcacttgtgaaattgcatgagctcctagcataatagtctctggagtattttggacactaaataaatatttcttgagtgaataaataaattctcgaagagctgcccacctttgacgtttttattctcctatatttttataggaggttaattctcccatatttttcttcctatatttttctcctatatttttcttccagtatttactattccattgatattataatatttattcaactgataccttctatgtgtaaggtgctgtggaatatataatactgatttagaaatagttcttgatctcaagacatttacagtttattaatatagaaaaatcatgtaaaaataaagggctagactgtaataaggagcataagagtcgtactaataatttaagggttcaggggagtgagaattttcttggcaagaaaaattaggatatctttatgaaatgatggctttaagataagccttgaacagttactgggattcaacctaagaaatggaaaggaagtcactctaaatgagtaggctagcatgtgtgaagatgaagggacgagaaaatgtattggttgataagtattcgtttagctcaattagagtaaaaaaaggagaaacatggaatataaagccagaaagaatttgaaacagatgtgcttggccataggcaataggacagaaagaatatgggtggtttttcacagggtgacacaaaaggttaatccataggagattgctgtgatcagacattttctttgggaagcctgttggaaagaaatgaaaggtgattgaatgctggcaagagaaataagtggtatcagagagatttgagtctctgagaaggatgtaggttctatttccagatatatgggaattaggagaagatagttttggaagtattaataggataatagtaattttagatatagtaaatttagagtgaatttcaggtataaatgtctaacatgcagtagaaaatatgaaactaagaacttgggaagaaagggttaaaataaagacaacaaaaatgattaaagaacatcatattatgtgatcactttctcaggtttaacacatttagtttttgaaaagttgctattttggaatcatttttgatttttattaaaaggcgcttctttacaaacaaaaaatgcagcttgtaattttttatattgaataaattcatatttatttaaaaataatgtgcagttacatcatttttacatttaattcccaaacatatgacaagttacaaatatctttttatattttgtgggactgttataaaattattagtcatttgtgcacattaaaaacccaatgccatattgaagaaataattggaaggtaaaggttatattttctccaggatattaaaatacgtatttctccagatctgttgttacagtcagattgtcactttttatttttcttatccttagacttaggtgaatgtgtattctagaatttatattaaggtcgacatgatccaaactttatgtcaaaggaactagatagattcagcaacattttcatgtttacagttaaattaaaatttcaaaatacttaaaattattatcatagcaaaggcttgtgataaattttaaagcatagatgtgtatgaaatgattgtaagagttcttgttttctctgtcttcaattatacttcccaagttagtattcctaaaatttgattatataaatctcttcaatgagaaaaaaagcacaaatatctgtctttttattttttatgcgtgtatttatttatttattttgagacagaatctcactgtgtcgcccaggctggactgcagtggtgcgatctcagctcactgcaacctctgccgcctgaattcaagtgattctcctgcctcagcttcccaagtagctgggattacaggcacctgccatcatgcccagctaatttttgaattttttatttttattttttgagatggagtctcgctctgtcacccaggctggagtgcagtggcgtgatctcagctcactgcaacctccacctcctgggttcacaccattctcctgcctcagcctcccgagtatctgggaccacaggcacctaccaccatgcctggctaattttttgtatttttagtagagacagggtttcaccatcttggtcaggctggtcttgaactcatgaccttgtgatccacctgccccggcctcccaaagtgctaggattacaggcgtgagccactgcggccagccatgtttttattttaatattaatatgtgcttaactacacatattatactgtaactttttaactgaaaaattgccataagcatatcttttaattcatgttttaggagaacgatagagctgtagatatcaatacttgtattatttcttccctttgagatgttttctaaaacaaaaagacagtgagaaaacaatgaatcaccacaatgtgatctaggcaatattagtgaatctggatattttttatgcaaagatactaaaatgtgattctaagatcttcattcacgttttcaaaccacatatactgaattcattctttatgttattctgtgaagcctccttgcaaatatgaggttacatgcttaaagactgttaaagtctgtcttagtttggagaagtatcagtgacttataaagacttcatttccaagaggttgagagaaacaatattttgttttatccgttcaaaaccagattagcattcgaagatatattgataccttggactggtacttagaagggagaagtttacagtttcctatgagacccagtgagatattaaacattgtgtgtaattaccttttacagtatctgctttgaaataattgaatagagatatgaatatttggcaaaatatgtattttattttagaatgcattatgagattaactcaagccacatttgccctcaggcacacaaggacaaacattctttgccttccattctgatatcttcttggctataggtcatcttttcataacctgagatctagttcacagtgaaggacatccagtgacatgtggacaatcggattggtagctcagatctctgttgggtatcttgcgttctgagagctacaacttttattatacagagactctggtcagccttcagtagtatatagttaaatcgtgggtggtttttgcagataatattttatttggagatttactgatgacaaaactgtttgctttcagagttattaaaaatcacagtgtgggctgggtgtggtagctcatgcctgtaatctcagcagtttgggaggttgaggtggatggataatatgaggccaagagtttcagatcagcctgggcaacactgtgaaacccaaactctactaaaaacacaagaaaaatagctgggcatggtggcacatgcctgtaatcccagctgcttgggaagctgaagcaggagaatcgcttgaacctgggaggcagaggttgcattgagccgagatcgtgccactgcactccagcctgggtgacagagtaagactcaactatcaacaacaacaacaacaaaagttacaatgtaaataaaacaattaagtacagaatcacacttataaataaaataattttaataatacaaatatttaaacaatgttatttaaaaatatttcaattttaatattttatactactgttagcagtaaaaatcctataagaaacactgattgtaaagtagtagcttggacattccatggtacattaattccaaaccttggacatagattatgtgctttcagtttgttcataatttattatgaatcaatgacaaatacctacctttatatttagtgttttcactgatttttcaggctaccgttcctttttgcctaatgagttgttaacataagatatggtacttttatcttcatttatttctctccttatagcatccctacaagacctacattaactagtcagcacagtgagctctgaagtcttggacttgctttatgtaacccaatcgctaatcacagggcccttccactgccgttttctttcacctgtgccataacttcagcccttatttccttttaattcatattgtggcataccaattctactaatgatcaacacatgccttttttcctcctatttcgtttgatttcttatgcaactctcacccattttatgtatctttactttaatagagacagtgacctgcaataattaagaattaagagacctggatccaaattttgtcttgtctttttattgggcaagtcaatattttaagccttaattactcaattttcttatctataaaagacaactctgtaaagttattgtagattttgaaaataaatcacttaacacttcccgtgacacatggtacttgataaaagctgggtagtcgcaggcagatggtcccttacccatagcccttagtttagatgcatttttagaattcagaatttatggactttaaaaggtatgcatatttcatatcgtacttaatatatccaacaggatgttagtcagcatctcaaacaagtggataattctgtaggacaatgcttatgtgtgaatttttacacagaaatattagcctcccattaattaaagtcaggtattgttaccaaatgagttatgaaaaaaccattattcaaattttggaatcgagggtaagtgagtaggaatccagaaaacaagaagaaatttttcatttttcttattgtaaactaaattttgttctttcattttgactacctggatgttttctaggtttcctaaatatgggaccataaagcactttttttacctacacttccacaactcatccctctccccagctaccctcaccactccagatgtcttctgagaattaagggagggaatgaaatagagttatttctgtaggagcataattgttgggcatggaaaattaatgtcacattaagaatttttttctccctggaatttgttagggtaagtatatattatctagggagaaaatgacacaaaaaagcattagtttttgtttcttcctttgtgatttaaaactggcttttcttatatatattttaacttagaagatgttttagcaagatttgtagttaaatgaaatacactagcaattttaacgtgtgtaatttattgttttacataagtatttttgggttttagagaaatgtagattgtcttactgacctgttgacattgatttttttttcttccactaataaggatctgtatagattttagtctgttccttcctgttatctattgatatgggggacttgctatcaggataaaagttgtaattgaattataatttcatattatgtaattattaatcacaattgattctagtatttttttttagtgtccaactgaaaccaaagcaacatttggggttcatcttaaaatagtaggagactggacaggtatgtagaacatacagttttaagatacattctttgaaaatagtggaatgtaataatttgaatgtgttttaatataactaccagcatgtatagagatgtgtatgtgtttcaagctgttctgggtttttttttgttttttttttttttttttttgcttgtacagttttgacatctgtgttttctcttttaagatgcatttttgcaatcagaatacctttgatatcagtaattattaataatatattgttcagtgtgcttgcaaatcataagtttctacctacttgtcaggtgtgctggcaatagtgggaatgctgaaatgtgtttcttagaaaacatgagtcaaaataatcaacacctgatattgagatcacacaaatcttccagttcttgcatgacattttttgtggtgttccagtatatagggcaacttcacagtaactttggaatagatatttttcacagcaggcctgttggtgatactttacttgtcttcagtaaatactttttattacctgagagatgcattgtagtaagagctttgagtaaataaaagaaacattattctctcttatattaatatttccttgacccgccagagtaactgacaagtgagtactcagtaaatgttggcttgttagttggttggttatgttattgttacaggaaagaatgcagatataaacatgaatgcaaaagtaaatttaaatattcttatacttaggtgctaaacgaggagttggtaagtaaaatctgtagggaaccagaaaagtgtagattaaatgtggtctagggctgtaagagaagcttcacagaaaagacagaatttgaactgaagcttaggagtcaggcaaatgaagaaagatgtaggtaatttaagtgaaagtcacagtgttgtcaaaaatcaggaaaggcaatgattaactctctttggaaaggatgaatccaatcagtctttaatcaattaaacaaaagcaaagtcaatcaaacaaaatgaaacaaagacaaagtcaatcaaacaaaagcaaagattttgttctgggtagtagcacagaaaagccatttagggccagcttggtgaagattatgaatgcctcagcaaaatattagagtaaccaagggactttagggaatttttgaagcatttgaagcactatgatgaaaatggtattaattaagttgctagttggacagattaaaatcaagggaagacttgaaggtacttaaaggcagaggggaaggaggcagtggaggggtggggatggaaattggaagtaatggatttgtgaatacaagttaagaaggtagcattagaaggaagaacctaatatctctaaaaaccagggaaggataagatgttggataataagaaagatgtgttttgaaatgaggagaacaatagtttatataaggaggttatttcatagagttaaaaaaaataatattggtatgtataaaatgtaatgtctttagaaagggtagccagcttggaattggagacttaaaaaaaaggaaggaaatctgcaacataggatttaatgggcaaacatctaagtgaattaaaaagatctttgagcagtaataactcattcagagtcatgaaaaaccaggcttacatggataattttcagatggtagcattcaaaagagatcatggtcgtcctctgataggtatacactggtggagtatgaacatatgaataatcacaatatgcccaatataagttgatattatcacagtgttttttttttctactgttttggaaataaaaaataaggaaagttcttttctggtgagaatcccaatatagtaggaattaaattcagtcatgaatggtaaattgatagaattctatatctgaaagaaaacatgcaatgaaaacataatttaattcataagattaagcagaaactcctgatggtttattattagctattgttactgagttttttcacaaagttattttttattaccagtagctcattaaaataaatgatgtcttactattttaatcatctctattaggaacacttaatagtgttaattttattctccctttttaatgtattatgtcactgagagaaacaagatcattctattcagagttcagttctagtcagatgcttttcaattaatagaccttctttgttgttgacttgaaatatttgttgacttggaaaaaaatataagcagtcatgcagagaacacctaaatagtcatgtcattatctgacactttagttcaaagagatttagctgccttacaacaatgagattacaactattgaaggaaaagtaggagcattaccttcaaaatcaagaatcattggtttttattctaaaagaattgattaaaactcggtattaagagcagtaggtataggaaataccaaagagatacctaagaggttgaatatcaaaggtttatttttttaaaactgacttagagatatttaatatgactttttatttgctgaaatatgttctgcattggcagcatacagggactaaagagcaggtttaaaatagctccagaaatgatctctccaagactaatcaactatacctagctatagagtgctggaggagcaagggaagcagctatgcggcacaagacaaagaagcaccaagtctcatatttgttgtctagattttcattttcaccagacctctaattgcatctcctagatacgtggaagacctgttaaagtttagaagacccttaaaacattttagacatgattcagtgttttttcttgaaatgatgctagtacagtagatggagtggattacccaagtagatttctcttttaattgaatgaataccttattgctcttctagaagcagccattctttccagtttcaaacatatggtcagagattattgacttgattatcattttaagtgtacaaaaatgttttgttaatttcttcgttacatatgattagtattgattaatgtctgagataatgctatacccttgcttattttggtggtctaaatagccacttattccacaggtgtttgtgttgtgctacaacagaattaaatacataacatccacatgtaattaatgtaaactttctgccattgatcccttcagcagttaatgaattagcaataattgtgagtaaatattcaataaaggacttgtagcatgtatcacatgatgtttctatgaatcttgggtataaattcccatgttgtctactggaaaagttttctacagtgagaagatatggttatcttttaggattaaaaatgagaagacagggccatatattattgtggatttgcctcagtcacataatatattgacttctcacagtgcaagtaatcttaaatataggtttagttaaggactgggccacaaaagagttgataactctcttatttgtttctatatcactgtaggagccagtcgtgttataggctttattcagatttttcatgaaaagatttaaacagaacatgtgttacgtgtttaaagtattttttttttcatttttggaaactccttgtaagtcagattataaccacactaatttatattaatgttattactttattatgacaacatattttaggccaattacatcaaccaccttgcactagatatcactgtgaatggcttttggttgctgcaagaagccaataaataaataaacaaacaaacaaacaaacaaataaataaataaatcatatttggatatatggaatctcacagattttacataattcatattcatacaatgtaaactttaagcttataacaaatattcattatcaactgctatatacccaaaggagtgcctggaagtactctttttgttgttgctgttgccatgactagtgaattacaacgattagtcatttgtggaagataatatttaaactattaactttggctaataatcaaatgtatgttaaacagctcctgtgttccagactgtttattagtcactggagatacagcattgagcaaaagtgacaaagtctccgctcttatagagattgtgttttggtccatggggagtttatcattttttttggagatgttttggtgtgactctatctcctgccacttagccatggtttatagattgtagtagcctcacctataccctatgtcctcccagcccctgtggatggtagtaattttcttccactctttgtattttttcaccatcctcaatttggcttctcacttcttccctcacctgagtcattagttccctctaatgaacttcttccacttaacttatgcagtcatgtttctgcctggatctgcactgttacacaaggttagaaaagctctctgaacagagccctgaataaagaggagaaatatataggggaattgcatttgcagcatacaaggactaaagaacaggtttaaaatagctccataaatgagttattttaaaaatatatatcttaaaaaagtttaagagataataaaagtaagagagtattttatatctataaaaatatatctttaaaaagtttaagaggcaataaagtaagagaggatgtggagttgttaagtatagaccagtctggcagtatgcttgggttacctcctagggcttgagagaagtgcttctcttcccacctccatagtcagtgaagtcatgtctgatagcttcccatcactcacagtgatagtagttattccacagaaattgaccaacatcattcccatggtgtgaatgtgtcccctgtaattcgtatattgaaatttaatcaccaatatgataatattaagaggtaggacttttaggtgatgattaaatcatgagaataaagccctcatggattagattagtgccttatgaaagggattgagggagttgattgactctcttctgctcttctaccatgtgtgttcctccccctttgctcttttgctcttctgttatgtaaggacacagcagtaaggcaccagcttagaagcggagagcagactttaccaggcatcaaagctgctggtgccttgatcttgtacttcccagcctttagaactgtgataaataaatttctgtggtttataaattaactaatttgtggtattttgttatagcagctctctaacaaagacaaccataaagtaggtcttatgtatttatctatcattagacctggctattaaacatttgccagaataccactggacaaattctaagaagtttgtatgtaaagtgaaataaagaaataagtcagcagctgaaaggaggaaataaggacgaagaagatataagttaaagatatatgattattttataataattataacaatatactaattatgttataatatatttatacacttatttgaatgatgagaatgaagtggagacaggaagttttatattgctggagagatttaggatatagttccaggagcaaatggaagatgtacaagtttctgggaagaaaacttgggaggctttctgggtcaaactgagtgttagagatatatagaacttgcctagagtgggggattattccacggagaaaaaatagcttgaatggctcagaagggtgaactagcttggaatgtcaggaaaatgtcatgctattgggaggcctggctggggtggcatccaaatattaggccaaggaagagcttgtagatcttgctatgaaacttggtcgtttcccaaaagatgctggtgaaatattgaggagttttaaacaggaactgaaatcaaatttgccctttatatgggtcaccctgccaatgttatatcaaatagaaaggaagaagactaggctggaggcaaacacatcacattaaagattttttagtgtcaagcaaatggaagactttatcttttgagttttgagaaaggagtgatctatgattgctgcaaaaagccaataaataaataaataaataagactgagcaatatcactgttagcctcataaaaatcatgtcattaggaagatgcaaaggaaaggtctggcgatggtacatattgctgcgaattactgagggcattggagaccagtaagtggagagagttagtgtacaaaaagaggcacatagcaaatgggcctattgctaaattcttcctgtttctacatttccccagaactatgagaatgattgatttttatactgatctggcttgtgattagcagcagaagatgaatggcaaatacagatgtaactacctgtgtatatatctagatggatctgtgtcaggatgaggattaacctattgtatcttaaagtatatatgctttgtataatgaaacactgtagttctggcctcttgtgagtctatgtggaaatcatttaggataatgatgaaacttaacatggcttatttactatcacaatataataaatcattcaatgaatgtgaactgggcataaattctacagcctcagaaatcaaggaaatttttttatcaggaaaatgagaggcacattatatgtgtactacaatttaagtgcccatccattctcaggaaagaagataaattgtttttcccttggtttctcattttatgaacgttaaatatatgctgtcatgttttttagtaggttacagctcacttaaaatactacagaaatataaaaattgcttagtaaataaagaattcaccagtcattaagttttattcgttccagccatttcacaaacccaaacataggagtaaataccaaatttttgttttctatccaattttcacaatgttcttttttttttttttttcttttcagtttttagagacaggtcttgctgtgtctcccaggctagagtgcagtgatatggtcatggctcactgcagccttgaccttccaggatctatggaaggatctatggatcctcacatgtcagcctcctgagtaactgggaccacaggctcagaccaccatgcctggctaatttttatattttttgtagaggcagggttttgccatgttgctcaggctaatcaaactcctgggctcgagcgatcagcccacctcggcctcccaaagtgctgtgactacaggagtgatctactgtgcctggccaaaatgttactttttagttttgaaaataaacaaatcatacaattactggacctggaagtagagttattgtggtgaagtggtttctttttatggattgttatatttttattagaattgttctgttcctaaaagttgcttagagtctctgttatccagtattttctacttgattttactatgtaacatggaagaaaataagaattatgagggattttcttggtaacataatttattaatcaatgtcaaaaacaccacataatgtactgaatggctaagaaggcatatgtcagtttgccaaatgagcctagcgttaatggactaagtaatttcaaaggaagcaaaaggacaagggttttgtgccattatcattattatcaggaacatttttaagtactcattttcttgatacacttgctaatcattttatgtatttgcttgttgtttttccctgatccatagtcttggtcttcggccaagacatcttctatttaagaacagagaagactcactacatggctgttttctattggctttaaaggcccatatattgcatggcattgattttatttgctcggttctttagatttgaacttcataaaacataaaagaaaatctcctggtttttttttttttttttttttttgtgggggtggtcttggtcttggataaaatggcctgttttttcttgaatacacatctaagatatattcagtttctgcagaagccaggaactgaattagtatggagctgagtcttgatcagtctgaggtgtttcttttgatgaaagccaacattgttaaaaaaaaatgcatttgatgtgacaaatgaaaatataacatttttcttaaaaggtggattgtagaaagcttagtagcaataatgtgtttacccaacaatgtctgttatttgccttcactttctttgaaactgttttttttttcccaccctctttcattttttgttatagtttagcctctgtggcaataaacgccaatttatattttataagaaatccagttctaggcattgattcattgatgtatttaggggccaagaagtctgtctgtagttctttcaaaaactgcttttgatttttttaaaataaagtgttaaacaaataagaagcaaaataatgagtatcacagaaatagacttttatcactctgctccccctggaaataaaaggatccattaaatattcttcctttgtgtaatactgcattgtctaccttcagaccttacagtatttaaaagtaccagatgttgaggcatgcagatggcatatgaccctgctaagctttctcttatcctgtaatccttaggcaagaagaaagtaaaaggagggaggggagaaaagggagtactgtatattctcgggagagaataaggcagtatgacggcagtggaaagaaccctggactgtgagtgtttttgttttgtttttgtcttttctttaagtatctttgcctctttctagccatgtgaccttgagacaatcagccagctggttggtttttagtttccttgtctacagcataccaaattgagggagttgtttcctaatttctcagttcattattgctgtaaagtggtataattattttgaaagaaataaattctaagatacagataattcaattccacataatgtgtgaatgatagtagataaattttggtatagttcagaaaatattacaggaatactatggagaatacatgtcaagtagaggatttttatgttgcttattttgttttcctattagtgttcttattcattcattagctctggttgtacatacatctcatcttctgaaaattacatgtatgggtttagggatttttttccccttatgtaagacagtataaagttctgttttttatattgctttgacatggccttaatatttgcaaaaaagatagttttatataaccagagcatgcgagtgatagggttttttcttctggaattgtaaatcattttattttcttctagaattataaatcattttcatttgaatcctagaatcttatgacacaagatttgtctacatatgtaatatatataggcaaatatatatgtgtgtgtatatatgtatgtgtgtatgtaaacatatatatacacacaaacagagagagagaaagagagagagagacagggtctcactctgtcacctaggctggtgtgcagtagcataatcatagctcactgcagcctcaaaatcctgggcttgagcaatcctcttgtctcagcttcccaagtagtgaggactacaggtgtataccaccacatctggctaattttttaaactttgttgaagagcaagggtcttgctgtgttgcccaggctggtctcaaatccctggcctcaagctttcaaatattgggaatgtagccatgagccaccacacctggcctgcctatatctttaataagttgcaacttgatttcctggtttatgtaaagtagtactaatttgagagcctctcatgtttatctgaaaccaatagtttaaatagcaacattgttactattatattgttactattcagttaccatgtattactatgcattaccatgtattattattgagttaccatggtaataaaggacattcgcttgatttaaacaaacttttcagtagggagatgtatgctccatatctttctagttggtatggatatactctaagtttgccctttaattcttctttttagaaggaatttgtttttctaagattaatatgcatacttctaaggaaaataaataccaaattttgacaaaccattaatttctttaaatccctagaaataatgtgcttctttccctttttaaataattttgtaattacattctaaattcttttcaagtagctataatggcattgaagttcttttgttgtcctggcattttttgtgtgtgcttaataaacagagctgccttggtgataataatttgttttgttcacagtatgtgacaaatgataggtactcaataaaagtttgttagatgagtgaaaaagtgaataaaacatgctttaactgatgaaattctgattatccaaaatattgattttattttcaattctaaattttctatcattatagattattgatatatatgtaacagagcaaaaatattcaccttatctagtaccacggctcaaaaggacttcctttgttggtttgttttattttttataaaacctctccgcttcttttgctttttgttaccagcatatccaggctaagttgactgttctattccaaactctcagagcatacctttagcacttatttacttgtagcgtttgtatcttttgataaataatttagaatgcaattacaaaattatttaaaaaaggaaagaagcacattatttagacctcttctctgctagacctttagcccatgaagaacctcagttggtgcctgacttacagtgcatgctcagaaatgttactgagaaattacttattttaggtgttcacattttgtgtctacatatttaaatagtaattcctacatgttgtgagaaaactcatttgtaccttctatttcaagcatcatgtgtgtgtgtttgtgtgtattgtgtgtctgcattggtgtggtgttttccttggtaggtggaggaggggataatactccaagatctataatatggggagtatgaatgaatgacaactactcttgaagatatgttcatgtgtggtagtgtgcacatccatgccctacatctactctttaaatatatatctatatatacacacacacacgtatagatagatgattgatagattacttttagataaatactgaaaactaaaattcaaacaaatctaaagattaaaaattcaaacaagatatagataaaataaaaagctattatatatgatcaggagccaacaggcaatacttaactgatagagtcaaggtgggcatgatcaagatactggacagcatggctggaagagtaatcaaaatggattgacagtgaccgcctgcacatgccacagaggtgttatttatgtaacatctggaaggttctggaaaaagagaaatgatttattgctgatctttattctacttaaacacatgcacatgcatcacaccccacagtagccgagaacttggtagaagttctcagtacaaagtggagatctatgaagcacctgtgtttcaggttggattagctagaaggtgtgtgtgtgtgtgtgtgtgtgtgtctgtgtctgtgtgtaatgtaaaatgcttattagggatcaatacccatgacaggaaagagaacaaagagggtttgggggaaggaagaatttgaaacaaggcaggttcaacaaagcccagccaaattggtgggaagaactagagcaaatattgcccatcagagttgcctgtgtagtgctgaaatatccttgccttgttcagtcaatggatgtgagctgctctgtgagaggtatttgctttgcatctgaggccgaccctgatggaagtgacagatggagattgcctgccaactgcgctctccacagctgggcaacaagttcttcactgaagaggcacttgggggatacttctctgtatcaactacatgacccctagcttattttcttattaatatttaattaaaaataaaatctcatgtgaatatgaaatggagcaggatgctaggacagcaggaataaaccagaatagtctcagtcaaacaaagacatgtggccccactccctttcagtgactttaattaagatttcttttcattccttaagcaaatattcttttttgttttgttttgtttcaatagtttttggggtacaggtagattttggttccatgtataaattctttagtggtgatttttgagattttagtgcacccatcacccaagcaatgtacactgtacccaatatgtagttttttatccctcacccgacttctaacattcccgctccagagttcttaaaattcattatatctttcttatgtctttgagtcctcaaaggttagcttagctctcacttataagtgagaacacaggatatttagttttccattcctgagttacttcacttacaataatggcctccagctccatccaagttgctgcaaaagacattattttgttcctttttatggctgagtagtattccatgttgtatgtataccacattttctttatctacttgttagttgatgggtgcttaggttggttccatatctttattgttgtgaattgtgctgctgtaaacatgcatgtgcctgtgtctttttcatgtaatgacttcttttcctttgggtagatacctagtagtgagattgctggactgaatggttgttttactttaagttctttaaggaatctccatgtattgtacatagtcatttgcactaatttacattcccatcagcagtgtaaaagtgttccctttttaccacatccataccaacatctattgtttttagactttttaattgtggccattcttgcagtagtaaggtagcatctcatcgtgattttaatttgcatttccctgatgattagtgatgttggccattttttcatgtttgttagctgttgtatgtcttcttttgagaaatgtctgctcaagtcctttgtccactttttgatgggattatttgtttttttcttgttgatttgttttaattccttgtagattctggaaactagtcctttgtcagatgcaaagtttgagaatataagcaaatattttttaagcaactcaaagttaaaaggtggcttaaagatcactgaactcatctgactcagttgtgagttcagaaaaggaattaagaatagaggcagactaaggtcaagaactcaggctctctgacaaccagttgagtgttgtttcttttattttttctttttccaagagaatttcttttctgctttatttaggtataattgacaagtaaaattatgtattttcagggagtacatatctctggtatacatatgcattgtgaagtgattaccacactcaagctaattaacgtatttatcacctcaaatagttacctttgttgtgtgtggtaagaatacttaagatctacttggcaacggtgtcttttctcttatgacctgttgctgctaaatactgcagactgtatgagtgaagaaagatttgtcctttggtatctcctttctcatgtatactctctgataatatttcctgcattaagaagtaatcctcagcctatattgccaaaacaatgtgaaataatatcgatattatggtgcattcatcttattgaccctttttggggtatgaagtactgtctgattccttgcaatataacttctaatactattaataggttacaatatactaggtgttcttaaaactaaggtaaagactttaatagagtcttaatctttaatgtcccttaaggatttcgttttgatgccatttaaaaaaaattaaaactggcaaattagtataatgtgagcattaacagaaagataaaaaaattaacctattaataaaaatgcaaagaacttctgttcaagtaccttttgtttagggaaatactgtctctcttagaaatattttatatgacttcttttattaccctgaaaaatctaatactcaaaacagttaaaatattcatttttatagaggaggttatagagaggcagttagggaagggggattacctgaaggaaaacaatgatttggaattggcaaaacctgtctgggtctctctagcaaacaataggtctttcttaggttgctgttaaaaaaactaattatgtgacagtgatcacatctctagatgcaaaggatctttaggttatacaagaatagcattaatcattgttacttttgttttttatatatttttttctttcttttttttgtagtggtaagaggttttattttcttctcatcccaggaataggtttgcatactgctaagttgcagtgagctgagatcatgccactgcactccatccagggtgacagagcaagactccatctcaaaaaaaaaaaaaaaaaaatgcctactgctttttattgttatgtaaatccttattgcatttggtatattctgcatattggggtggattagagattggtcattttctgcaaaggagaaaatgaaacatcttggtcacaaaaagatgtagaaaaagtttcaattagaaattgaaagaggattttaattttctcatctttgttttcaaataattaagtatattgtgtcacagttgattaaccagagaatgcaaattaatataattgtgtgcagtatgtcatccaggtctaagggcctcataatctttttgttgattgaatgggagaaagaaagagtggatgaaggtctacaaaagcttgtgttaattaagatatatctcctactggtagaaaatcacgttcagacattatcacatcgttagtcagctcatcacggtatcacttcgcagaaaatcctgtttttttttttccagtggctttaatgaatttcttctaagaagtcctgtgaaaggactgagctgtagtatttggataactgtgccattttcttaagaaacagtttgagcctgctgagaaagtaggtcatctggtttgacattttcctgcaaaagaagtagcattaatatatctttttttttttttacttaacaaataaaacatcaaattattttggccttttcctcataatcaaatagacaacaggatgctaattaaataactgataggcaaaaatctgtgagactaaagaactaaataattataaataatttttccatttacttgaacttttctaaggataattgttatcatttatctatttttataaagaaataaatgaataatcagtatgcctttataagataaaattaattgttcacatttaagaatttattaatataatgataaaaataaaatttttttaaaagacatgcttttaaagttctgtgtttactttctgtttatgtatatatgaaccctttcttttcttttcttttcttttttttttttttttttttgagattaagttatactcttcttgcccaggctggagtgtaatggcatgatctcagctcactgcaacctctgcctcctgggttcaagtgattctcctgcctcagcctcctgagtagctgggattacaggcacccaccactatgcccgactaattttttgtatttttagtagagacagggtttcaccatgttggtcaggctggtctcaaactcctgaactcaggtgatccacatgcctcagcctcccaaagtgctgggattatgggtgtgagccaccatgccctgcctatgaacctttttgacaaccacgatagctattcaagatgtttgcttggtattctttgtatttctgataatctgattaaaggatgttccaaatataggaacattagttataggtttccttatagctttataagtgatgtcttttttgctgcttttgctgtatgtgtgtgtgtgtgtatgcacacacacgtgtgcatctgtgtatgtgtttttagtcctgtcaatatgtcatctgcagagattcttttctctggaattattgtcatatgtcctttatggttatgtaaaaagagaaacacttattgctgcgaaaaggatgtattatattatagttgtgtgcattaagaattccgaattttgtttgcttttaacaagtttgggagaaattcactaaactttaatttatactattacctttcaaggaatatcataacacatatagctgtttgatttaacggttctttacctgatatgtaaagttcttgtttgctgttgggttttggcttgatttttcaagactcattttaggaaaaggctaagtgggaaaaaaattgaaaagatagagcattacacattactcatttaatgagtactgcataaattggcaagtagactgaaaaccaagggttatttatcatcagaaagtttactagtcatttgattgaaagaaatgttaattttgtaaattaaacagagtaatatcagcccaaatatcagccaataatataatatttaaaaatgtgaactaaaagagtataattcgagaaaaacacagagtatttttttggatttctagacttcagagtgtaagcacatctgtgtttggatctcattagttcctcctcatctatgttgtaagaaatgtcagaattttgagagaaaaaaaaacagtagaagccagttatgtatctctgattcagtatgttttaataaatatgaagataaaatatacattctgcttctcaggaagcactggccactttgtgactgccgtattccaaataatttaacatctagttattcataaactaggaaatggcaattgtcatcaagtgtatattttcatcattttgtggaaatgctcaccttcagttagtgaaggatttactgcagctggggagtgttagctttgcatactatctaagcctgactgtgcgaccgtatcaagacaggagtatgggtccacttgctgttcatggttgatatatgaccgtttggtctctgctgggagttattatgattaaccttaacaaacagttttctccagtaaaaatagatgttggaaatatttcttcaacaaatatttatccagcaccttaattatgtatcagataatgttctgtatcttggtggcacaatactcatctactagaagaagaaagagggatagagagataaatacatataacaataaaacatagtgtgataaactctgtgaaggtggaagcacaagttgtactgggagtgtacagtaggtccagcctattccaaattgggcaggaggagagaacaaaaaagtaatggagggatcaaggaagcctttccataggtatgactctagaggtaatgcatacctattcctgaaaatgtgcatactctatgccatgcagatagctatgcaacgtaagtatttccaaggtaacatctaggattttttcctttgtccttctttttttttcccccttcctcttcccctccccctcctattttctctcttttcttcattatgaattcatatgcactgaagtttactaaatcaattcttagctcatgatatgcagtcattattggtcttttcctggccgtcattcacttatttatttattcatttatgatattacaattaatacatatgaaacaccaacaattacttacatttacccttttgcttctctcctatttcatccccctacctttcctaaaagatagtcattattctgaattgtgcatgtccttcctttttaattggtttgctttatttcatatatatcatacttaaataatacattgcttagttttttaactcaataaaaattatgttctgttacatgcaatctgcggagattttatttcactcaacattatattaatatgattcattaggtttttatttataaataaaatcattcagtttcacttcagttagtacttcattttgtttgcgaataagcacaaatgtccattctctcatgtcaatgagcaactgagctgcttccatttatgttgttctatgagtggtgctactgtgaacatgctcatacttgctgtctaagacacatgtgaaagtttctgcagggtgtgtccctgagaatggaaatattgggccacagactttgcaaaagtaaaacttaaatgataatgccaaattgtcttcaatagctattgtaccaatttggactcccaccagcagtacataagagcttaggttgatcaacatcctctccaacacttggtcttgggagactaatttctgtcaattgaatgctacatgatgtaaatgctagttaatggtgtctggttttgattcacattgcatgggttactaaagagactgtgcatctcttagtatgtttattggtcatgtatattttctctaacctttcaatgataagatttgatcataaagatatatgttaccattaaggaaaaaaaatatatttttatatttatatatgagaaatatctatatgtagaaatgtatatattatgtatatttataggataaatataactatttcaaatattaatccaggcttaattttatatatttaaaatatatatatgaatatatattatttatatatttatacctatttatccttaatggctacatatatatttatgattaaaatattataatccatctatatatatatacacacacacacatacatacactatgtatatattagtaatacataaaatggtgggtaaatttctaataaaggatggatatacagtcaaaatgtctaacaaaataaaccaataggaaatacttccattttgaaattattttcatgacttttatcttttcacagcttgatgtttatttttcttttgacagaacgatttcgagatttactactgcctccatctagtcaagactccgaaattctgcccttcattcaatctagaaattatcccaagtaagcaaaaggagttcactgggttttgatgaggcaatgggcatagtgctgggagagatttgggcaggcaaaaacaaaatgtaatctttcttaagatttctgaaaatcttgaataacttaccctaactaactaagacatcttctgcaatataatgtctcaggctccttgcagctgggtcatagaagaaatacttacttgtaattgcaacccagctttgactgaggagctgccgcacagtgcagacaacatgctgtgtgcatctgtgtctggttctttttgcttgatgtcatatcaacagggacagtattttgtcagtgatgcctcatctggttttctatttactgtcctttaaatgcaaggattcatttatattgtagcaagtcattttcaaaatagccgtgggctagatatgatttttgacaatctctacatattcttatgatttttgacaatctctacatattcttatttatcgtattgaaaacaggggaaatgaaatcttctgacgctttgttatgtgaagcagacctttccttctcatagatgccccaagcgtatgtccttgttgaaggaatatgccttcatcttcccgaaggttaaggaaataccacgactcttataacacatctccttccctaaagactgacgcatgctgaatcttgatcattcctgtggcatcttggggcctcctctatgagtgtttaactctctttaattgttagtgtgcaacaggctaaagaataaataaactaatatctaaaatagaaaagaaaggccatcaacttaaaggaatagaatttggtttatacatatttcatctaatcactatgccaaattctttcatcgctttgagagttttttcaagtattcataaactttgctttccggggaaattattttccctctaatacttagctttgataatactcacttaattatgatcacaaaaataaatgcagaatcctaattatactgcttgtgcattgtttcaaattttaatccaggcttaatttttagcaataaacttgcaatcccctgataacacacacaaagacatacatgtgcctatacagccttgaatgcatactttgctctatacgtacatgttgaccaggagcatgaatgtgcctaaaaggattggtgcacgcctatttgtatttttacttacagtggctgttggcagaggctgatgatgcctgcttttctgcctcttaggcttacagtttgcctaatgcctttgcttgaagagggtagtcatagtagtttctcaggtggttatctatttgcagctacaggaatacctcagagatattgtgggtttgattctaggccactgcaataaagtcaatactgcaataaagctgtcacacttttttttaagtttctcactgcatataaaagtaattttaacagtattctgtagtcttttaagtgtgcagtagcctagatatgtctagaaatactatgtacatcccttaattaaaatatactttattgttaaaaatgctaacaatcatctaagccttcagcaagtcataaactttttgctggtagaggatctttcctcgatgttgatggttgctgactgattaggaaggtggttgttaaaggtaggggcacctgcggcaatttcttagcataaaaccatgaagtttgctgcatcagttggctcttccttttacaaaagatttctctgtagcatgtgatgctgtttgatagcattttacccacagcttaacttctctaaaaattgtactcaatcctctcaaaccctgctgttgctttatcaagtaaattgtcatttcagcattttcatagcttctttaccaggagtagattttatctcaaaaaaactactttcttcctgtaatcccagcactttgggaagccgaggcaggtggatcgcctgagggcaggagtttgagaccagcttggccaacatggtgaaacccatctctactaaaaatacaaaaattagccagctgtggtggcacacgcctgtatttccagctacttgggaggctgaggcaggagaattgcttgaaccgaggaggtggaggttgcagtgagctgagattgtgccactgcgctccagcctgggcaacagagtgaaactcgatctccaaaaacaaaacaaaacaaaaaatgacaaacagacaacaaaaccaaaactactttacttgctcatccatagtaagcaacttttcatttattaacattatatcatgagattgcagcagttcaatcatatattcaggctccacttgtaattctagttctctatttatactatgtttgtagttacttcctcctctgaagtcatggacccctgaaagttatccatgagggctcaaatcacttcttccaaactcctattaatgttgatattatgacttcctcccatgaatcatgaatgttcttaatagcatctagaaggtgaataattttcaggatgtttttaaatttacattgcccagatctaccagaagcatcactgtctatggtagctatagccttatgaaaagtatttcttaaataataacaattgaaagtcagaatttctctttgatccatggattgcaaaatggatgtaatgttagcaggcctgcaaacaacattcatctccttgtacatctacatcatagctgttggttgactaggtgcattgtcaatgagcagtaattttaaaaatttatttgtataaatttttgtggtacgtatgtaattttgatacatggatagattgtgtagtagccaagtcagggcttttagggtatccatcaccagaataacatacattgtatgcaataagtaatttctcattattcacccacttcctagcccccctgcaacctttcaagtctccactgtctatcattccatactctacatccatgtgtacacatcatctagctcccacttttaagtgagaacatgaagtatttaactttctgtgtctgagttatttcattcagggtaatggtctccagttttatccatattgctgcaaaagtcattattttgttcttttttgttcctgaacagtatttgattatgtgtatatgcagtattttctttatccagtcatccattgatggacacttaggttgaatccatttcattgttattgttctggtgtgagctttgcttactgcctatgtgagtagtaacactttggatagaatcttctttttttttctctggtgggcttaaaatattcagtaaaccatgctatctataaacagatgtgttttcgtctggactttgttcttttatttatagagtgaaaacagagtagatttagcataattcttacgggccttaagtttttcagaatggtaaatgagcattggcttcaacttaaagtgaccagctacattagtccatagacaagagttagtctatcctttgaagctttgaagacaggcattgactgctcttttccagctgtgaataccgtagatggcgtctaccacttgatggctgtcttgtctacattgaaaatctgttgtttagtgtagtcaccttcatctattatgtcagctagatcttctggataatatactgcagcttctccatcagcacttgctgctttgctttgaacttttatattatagagatggcttcttttcttaaacctcatgaaccacttcttctagcttcagacttttcttctgcagcttccacatctctgtcagccttcatggaatagaagagagttaaggccttgttctggattagtctttggctgaagagaatgttgtgttgtggctggtttaatcatccagaccactaaaactttctccatatcagcaataaggctgttttgctttcttattattcatatgttcactgaagtagcactttaaattttcttcagaaactttttcccttgcattagcaatttggctcactgtttggcgcaagaagcctaactttatgcctatctcagctttcaacatgccttcctcactaagtttaatcgtgtccaatttttgattgaagtaagagacatgcaactctcctttcacttgaaacttagaggccattttagagttgttaattggcctaaattcaatattgttttgtctcagggaagaggatggtcccaggtaagggaataagaaggagaaatggttggtagttgcagtcagaacacacacatttattcatcattgcagataactgaaagtcaaagaatttgtagctttgtaacataaaaaaaattctgtaaagttgaaaggtgagtcaaacaattagaatgtatttcattcacaaccactgctgtatgtatctacattgatattttttcctcatttttctgattgaaatatgttttaagacctaaaatatgggttacaaagcaacttccttgccctataaagttataccatatcacagagtatttacagatcattgcataaccaacatagatcataacatcactaacatggactcattgtgcactggttagtgtgagctgtggtagtttggatttggacttgggtttctatttagtcaacatagtgtccctataatctttaacttcctgttaccaagagacatctaacaaataatgaaatatggaaatgtatgtcctttatataggtgaaaaatattcatgaagagaactgactagttctgaaatgtatatgtgtatgtatgtatatgtttaaaggaaaggcatttaaaaaataactcctgcaatggtgcttgggaacactcttctaaaatacaagaatgttcattaatcaatttttacatttgtgagctcttatttgacccactgccaaagccagggcatccattctcatcaggatgtaattgtagacattgctccatgaaaattctcagaacatgaataggtgtgacagttgtcagaaagagacagatgagtggaaaggaataaaaaaagaatgtgcatctaatacaaaatgcatattgttgatttataggttggaggaaacaaatggagataaaaaacaagttttattgctaataaactctgaaggatttaggttcataacatgtagactagagagtagttataatatatttttatccttgtaaatacagcttggacatgtaaaatggttaagtacatctggtataattttatccacaaattacttgcaaccattttggcaattaaaccagcaaaacatgacccattggctctggaagttttaaccacaatgtaggtaaaaatattgtgaaaatacaagaataaactgtttctacttggttctcataaagatcaagttctctgagcttcctaatatcggaactgtttagagagaggaatatcatttatgacaaattttagagctgttcttttttgacttggtttgctgccaaagaacaaccttgattgtttggacaataaaagcaatgtcctacctcaatctcatttctaatgggctacgtaaaaatgacttcaaatggtgattttgggtaatacccttaaactgcaaagcctcagatgacctttccatagtctgttctccagcttatcctcctttctctttcctagccaagttttgagttcttcttcaagatatcatctatctttaataatttctgttcaatctgcatgtctgtaatgtacttgtcatctgatcctgagccaagttattttattttattttattttattttattttattttattttttagacagagtctcgctctgttgcctaggctggcgtgcagtggtgcaatttcggctcactgcaagctctgcctcccgggttcaagcaattcttctgcctcagcctcctgagtagaagggtttacaggtgctcgccaccatgccgggctaatttttgtatttttaatagagacaaagtttcaccatagtgaccaggctggtctcaaactcctgacctggtgatctacccgtcttggtctcccaaaatgctgggattacaggtgtgagccactgtacctggcccaagttatttttgtttataatagtaacacataatgagcactacacatccaggaattgtgctttatatgcattattaatttaattcttactattcctctataagttaggtagtactgtttccctaattttacagataagaggactgagattcaaagaggtaaatgccctacccaaagtcacatggcagagctgggtctccaatccagatttgtttggcccctcaaattatacttaacttagaagtggtgggtcattgagggattactcccaggtggctgaaaactgtgtatgtgtggagcacgtgtgtgcatgcatgtgcaagcacacatacacttggagtcgaggtataaggagaaatgtggacagggcctagaataccctttgtcttctgaggcaaggtctcactctgtcacccacgctgtagtgcagtggtgccagcacagcccactgcagcctcaacatcttgggcttaagtgaacctcctgccttggcctccagtgtagctgggaccacaggtgtgtgccaccaggcctggcatatatatatatatatagttttttttttagagacataggtttttttttgtttttttgagatggagtcttactctgttacccaggttggagtgcaatggtacaatctctgctcactgcagcttctgcctcccagattcaagaagttttcgtgcctcagcctcccaagtagctgggcttacaggcatgtgctaccatgcccagctaatttttgcgtttttagtagagacaaggtttcaccatattggccaggctagtcttgaactcctgattctggtgatccgcctgccttgacctcccaaagtggggattacaggcatgagccaccacacctgaccagagacataggtcttatcactttgttatcacaggcctggtctttgttgcacaggctgctcttgaactcctagcctcgagcaatcatcccacctcagcctcccaaaatattgggattacagatatgagccactgcatctggcctggactgccacttaaatgaccttggactttgttgtaaagacaatgaagacccatgaaaggattttaagccaaggagaaagataattagacttacatttttatagatttctcatgaaactagagaggtacatgagctaccgcatggggccagcacactagctacttggcaatttcatattcaggcaagaaatgataatggtttgtactgtggtaatagtaatatggaagatcagatagatgtctaagggtgttcggaggcataattaacagaatgtgatgactattatgcaagaaggagaggaggagagagagggagaaggaaagagctttgggtggcttcaagctttttcccttgagtcacattctggtttaagtcctcatgattgagggagagtggcaatctgagcatctttatgttgactttttgttctgtattacaaatgatgataatggagataccttccttctaatgttgctttgaggaatgcccaatgcatgacacaattctttcttgtaagtctttgtgatatttaaataaaattataaaaagcacctggcctcttgcaaaagtgaattctcatcaccattctcgttgtcagctctgttctgccatttctcaaagcaattgcttgcctcagggcagggggaaaggctctgccatgtgggctgcttttatatcttcaatccattctaaatcctgtcagaagagatacattgtcctgtctggtagaggtggctctgggtgatatgctctgcttagattagtcaggaaggagccctttcccttgtgtgtctgcatatttgtggtagtggttattccggtacagtttctacaagcacagtaattcataagattttccacagtatacataatgtctttcattaaagaattactgtctttcatcttctaatccttaaatttaggctttcttttatatagtatgtgaaattcgaatacctggatggcaagagatctaaaaggtagtattctgactagagtgtggaatgtagttataagaatgcctaatgctactgatgtttgcaaaactacgcaagtaggatgtctgaaggacgctggtctatcagcaggtagtggatcccaacccctgggctgggattcacaaggctaaaccctgtcatcaggactgtaaaactgaggcactgcttaaattgtaaagattttggctcagagatctaagtcaagaagctgtgttagcgcaagactaatgagcaagcaataaacaagccttagtgctgactgagagcacaactcattcccgactcagataagaattggttgaaggatagggccaagccgagtctatagctggaggttaggtggctaaaatttcagaacaagttggggatgtagccactttctggagatagattaagcacaggtaattctccatctttctttctttgttaccccatcctgcattcagctgccatacatcttttcagactctttagtttttatgtttgagggatttttgttgtttatttggggtttttttttttatttttaggcagaaattgtcagtcgacaaagtagcctaaagtccttcctttcttaaaaatcttatattaaatgtatccattcataatggttattggagcataattttgttagcatgattattttatggggactccttgccaaagaacttttatccttacagactttaaattaattaatttgtaaggccttgactgaatcattcagaattccaagagataaacatcaaattggttttttttcaaaccatgttccttttaacatgagattgcattagataataattacaaattattgtaagtgggcttgagttcttgatttcgctctcagcttgaacattactggtacatggaaatgctgctgatttttgtgcattgactttgtatactgaaactactgaagtcatttatcagttctcttggcagagtgggtttttctaggtatagaagcaaatcatcagcaaagagagatagtatgactttgtttcttatttggatgcctttcctttctttctcctacttgattgctctggctaggacttccagtgctatgttgaataagagtggtgagagtgggcatccttgtcttgttctggttctcaaaggaaacacatccaccttttgccaattcaggatcatgttggttgtgggtttgtcatagatggctcttattattttgaggtatgttccttatatgtgtagtttattgagggtttttaccataaagggatgttggattttatcaaaaactttttctgcatctattgagatgaaaataggttatttgtttttatttatgtttacatgcaaaaacagaaaactaaacattgggtacacgtagacatgaagatggaaacaatagacactggggaatacaagatgtgggagggaaaggtgcagggattgaaaaaattacctacctgtattgaatgctgctgtacactgtagagtacagtattggttgtttaagctcatggtcatgtgtctggctggaagctgtggcagctgcccagcatcatgagagaatattgtaccaaatactactggtacaggaaaaggtcaaaaatcaaaattttaagtacagtctctattgaatacatattgctttcactccatcataaagtcaaaaacatttaaattgaaccatcctaagttggggaccctctgtaaaatcaccacctgtaccagctcactcctgatcctccttacctgctctatcagcaacatcagtagctcctgggggaatggtgaaaactacaaatgctcagacttctgagtcagcaagtcttggggtagggcctagcattctgtgttttaagaagccctacaggaaattctgatacacagtaaaatttgaaagctatcaagggagaaccatcatgggctttttaaactcattccttttgtttattgtttctattgatatgattatctcctgagactagaatggtctaaaactgccataccatcctctcctgaggaatagtttatcacactcacttttttcctacatgaagagagaattgttagatgataattgtcctggaagctttttttgtttttacctttatataatacccctcaccaaaataactggtaattgtaaagattattatctgattattaacaaactaagctttggagttagactcagaatgaatttagtaaaagtcatccccccttaatataagtgtgaccttaagaaaattatttaacctttctgagttttagttcccaatgcaacaaaatgggcattatactttcctatgaaagttgttgtgtggattaacagtgaaggtatacatagaacattcagtaccaaccttggattaaatgttcggtgaagagtatccattgttaatatagcttattttaggtttctgaggtaagagtctcaggcatgtcttgaaaaagaaaaaatttttggacactgagttttactctgtcacccaggcaggagtgcagtggtgtgatcatagctcactgcagtctcaacctcctggactcaagccatcctcctgcctcagcctccctagtacctgggattacaagcatgtgccaccgtgcccagctaatacttaagacaagggtctcattttgttgctcaggctgggcccaaaattctggccctaagccatcctcctgcctcagcctccctaagtgctgggattacaggtgtgagccactgcaccagacccttgaaattttttattaattaaaagaactgtttaaagtgacagatgatcagagaagattttaaaaggcaaatatttttcaaaaatttacacttatatgaacattaaatgttgtaaattacaaacctttacttttaataataatataatatttattatattattcttaaatatctaatatttatcaggttcttactatgttcaggcaccatgttaaaagctttaacaagtatattcacattcagccacataaaacagaaatgtagcttgaaactcattaaccttaataaaagatttaaatcagtttttttaaatgtaaataaattctactttcaaaggaaaaacttaaatgtcaaaaaatgtttatatacttttgagtgggtcagggaggaagatatctcttattcttagaattatcttagatacacaatccttcataaaggatcttttcattagttatcaacagaaatttaaaaatatatgaagttgatttcatctctactatgttatagcaagactttaaagagttgcctttaatttctacaatctggttacatatattatgataatagcaacataacattcttttaaagaacatgtactatgatagggagaaagtcactgctcataagtgaaacgcagtgtatttcacacatattaatcagattaaatatgtaaaaaaagtggtttaagtagtttccgtttccatctccctcaaaaaagtagatgtcatgaagtaatcaaatactagtaattttatcttcttattttttccaagaaaagcaaaattttctctctcctggtacaaaaaaaaaaaaatcaaatgaaaaacaactgattctctaagggccttgaaatcaaattcccacctacatttcccagctcatactggacttagcccatttcttgcatcaatactgggcctcccagaaggcctgtcagtatactgtaggcactcattgataccgttaataaaatgtatttctgatatttgtgtggccctctacaattcttagcacactttttttctgtagcatcccaacttattgacccttttatagatgaaagaaatccagtttagagaggaaaagttatttgtctggaatcccagccttagtaaatgactagaacgctgagttctagtcgtcctgtccaaagttatttcaaaacaccaaagagtagctttgtggggagtggggagggtgtgtgtgtgggtgtgtagctcagaaagcagacaagtaggaaggagggggcagtggccaaaatatagtcacacagccaaaacagatgcagggagtctgagaaatgtagtattttggctggactttttgcttccctgaataaaattaattgtctgttactaagaaagaatgggaggatgaatattatatgaacaattagcatttctattgcagttaagaaggatttctctatgctctctctctctctctgtctcacacacacacacttgaatatataaacatgagcagagtaattagagctgcagagcttcctttgtgattgtcctttacagctaaagaactatcagtttgtaagtaaagttttatacttatgaacaaccagggcaagaggagggacagtgttagattcttttccttactcctgctatttttctgttcacatagtaaatgtttaaataagtatttccagtactgatctagccattgaaaaaatgtttattgaatttagacacagtaaagcaattgttactttaatttagtcatatatagtctaatatatgactatattagacatatagtctaatatgatcagagctttaacttgtccttagctacctggcatgatcatatttacattaccctatacttttaattaatggtttcctcaaaaaagacacacttagaaacagacgtatttattttaatcttgacacttcataagcaacatttgctactcctttaggctaatcactatgagaaaccatgaaataaggcctgacccatcacaaaatctagagattgcattcagcatgtttgctatatggtacagaaaattaatttcacttattttcatttttttcccacctttttctgactgctctacaggctgtatattgatggtccttttggaagtccatttgaggaatcactgaactatgaggtcagcctctgcgtggctggaggcattggagtaactccatttgcatcaatactcaacaccctgttgtatgtcattttgatctattttgttaatccaaatagagaactgccaatatttctgatatctctctttttagtataaaataattccttattgaattattctacttgttgatcaaggacctccatttcctgattggtgaggggaataattcagtgattctcaacatgtggtctgtggctgctagcatattctcttgtagaaagatgtcatatcacagttatgcactcctctgtccttttcctctgttaaaagtcattcgcctccatccttcattttctatgtcctcatcagcggtaagtggttctactcattcattcagtcaacaaatatttttgaacacccatgtgccaataggtcttacaggtattgggaagacagcaatgaatgaaaacagagtccctgcccttaaaaaacttacattcaaatggggcaagtaaaaaagaaagcaatgagaaatgtaaataaaattatttcagaaaatattagaattatgacaaaaggtagacattaatggatatggaaataaagggctgggtttattgttgaagtatggtcaggcttttctgagatgacaactgaacacatcattccttcatttattacttagcaaatttacaacagactaaagaaagtaacttcaaaggtgaaattgtggccgggcacattggctcacacctgtaatcccagcactgtgggaggccgaggtgggtggatcgcttgaggccaggagttcaagaccagcctggccaacatggtgaaaccctgtctctactaacaatataaaaatcaaccaggcgtggttttgcatgcctgtaatcccagctactccagaggctgaggcatgagaatctcttgaacctgggaggtgggggttgcagtgaggggagatggcgccactgcactccagtctcggtgacagagcgagactctgccaaaaaaaaaaaaaaaaaaggtgaaattgtctgaccaggaaatactaaactaaaacttattttagtttcaggattataagcaaaagttaattgattgatattcttatgaaaacacaaagcaaaatgaaagtagaaagttattctcaaatctattccatttactattttttttgcagaaccaaaaaagcaataataaatttaagtgatgtgtttgaatgatattttatttcagttttaaatactagatgtaaatttggtactttctggcggttcttacaaaaatgatcatgctctaagccagaaatagtttgtttctgacaacacattacaagttatttggacacctaatgttatgaaaaaggaagaaaattttcttaacctcaagcctactttataaatggggatccagacttggaattatgagttgctggaatgcattacatcatacatgattgtgaaatctctttctttaatgatttttaagaggggataaacaaccaagtttctggaatggttttggctcattttgccaaaaagccagggcaagactgaatgacctttggagccctactcagtctgtgatagaattcactgaaagttgaaaacttgttttttttctgagatgcagagcccaatattattctggtccagttcagttatggccttcaactggaaatggatgatatgcatacttgtgaatattattcacacttaaattcatttaacacttaaacacctaaattcatgaagtatgtcgtatccttgagtcagtatattgcatattaaattcatttaggtctcgtgctatcagacgctagaatgtaaatgactgatttttctgttggtttctattggatatttctattggttgcttactaatgaaaaggaaactttaaaaaatatacgaattctttaatatttgtgtttgccatcctaatcactatcatgttattttcattttaaagggatgactggaaaccatacaagcttagaagactatactttatttgggtatgcagagatatccagtccttccgttggtttgcagatttactctgtatgttgcataacaaggtaacattagggttggttctagttttgcaatttttcaaattaaaaatgttatagcttttatattacaaaagcaataaatgcttgccatagaataaaccatagaaattatgcagataagtagcaaggaaagaaataagtctcttaaacataaaaaatcagagataatatctgttagcaattagacacacatcttttcagatatggatatttgtgagtatgcatatatatctaatatattttaacatggaaacattcatttctatgttttaacatagggtgtttcacatagaaatgtatgcatatggctaaaggtgatgagggaagacaatggagggaaataccagaaggctcctgctgtaacaccttccatcctctgttctgatagcacttacccttgattgccatctttaatactgcaaatcaccagactttttggtatactatacaaatctcaacaatcccaaattttgtgttttattttttgcagagataaagcaggaatcttttcctatcctacgtgtaacatttgacctatttatctttattcacactatacaagtgatacacatatgtatccttgctacaaatatttcaaacaattctgataaagtaaaatcctctcttactaccttccctacctaatctatgtaaacagaggtaactcttaagtgttctataaattatatcatactatttatattgtttatgcaaattcctttattaattgattactgtgtcttgactattttttggtattagtgcatctagaactacttcactgtttttccctgtgccaacagttagagatgatagacccacctgattcttttagagtatttcattgtatagatttatctagtttactgaacaattctctaatgttagatacttttttattacaaagaatgctgaaatggatatcattatatatacctctttgtgcatgcattcactcattcagtcagtcattctatcattcagtgtatatttattaactgcttactatcaatctgaaactattctaggatctgaaaactcatcaggtggcaaaataaaaccaagtttctgatctcatgtggtttacattctaagggggcaagatagacaacaaccaataaatacatccagcatcaggttctgagattcaggttaggacaaagaaggaagggaaagtaggagtaaagcagcgtaaacagtagagagtgtgttaatttatattgcatgttcaagaacaaccatcaaacaaaatgctataatgccatttgagcagacttgactgaagtgaatgagcagactagacacatattttggagaaaaaaaatcaaggtagagaaacctaacttcataggcaagggctctgaggcagcagtatgcttggtgtcctgaaagaagagaaaggagatctgtgtggatgaagcagagtaagcaagagaaagaatagtaggacaggcaattagagaggtagtgtctgtgcttttctgggaagaggtggattacgtaagtcctccagactttatgcaaaataagtaaataaaaataaatgaaaacattggttctaggtatgtacctagaagaattaaaagcaggcaattggacagatatttgtatgccaatgcccatagaagcattattcacaatagccaaaggatggaaacaacccaaatattcatcaatagttgaatgaacaaattatgatatacacatacaatgcataactattcagccttaaaaaggaaggaaattatgacacatagtacatggatgaactttgaagatataatgctaaataaatatgccagacacgaaagcaaaaatatattatgctgtcacttataggaggtccctagagtagtttcatttgcagaggcaggaagtagaatagtctctacatatgcatccttgctaaaaatatttcaaacaattcagatacagtaaaatcctctcaggttgccaaagccttcggggagggggaagtgaggggttgttgttccatatttttttctagactatttatttttgcaggtatatttttgcctcgtgcatttttgtacaagagaaaccagagcccattattgaataagcggaaggaaggaacaggaaaaagtgtctatttgttttgttttatatttgctagcatgcataaattaaatcactattgtctttttttctcaagaaaatcatgttcttgatgagtaaactggtacaattttgagactcttaaggaataaaataaggagtatttcagaaggactaatatttgtacagcattcagcatgctaaattttgtatctataaagataacagaaaattattccctaccactaccaccatcagaactaattaataccaagaggccagattattaacgttagaatctgttatatatatttctgtgtatgtatgtgtgtgtgtattcattttcttatagatattgactatgataagctaggttgtgttaaattctagaatcaagtatgttagaataggagaaaatctgagtatacccacagaattgtaataagtctattcctttttctgtcctctcagttttggcaagagaacagacctgactatgtcaacatccagctgtacctcagtcaaacagatgggatacaggtatgtggttgatgttatcgtaaattaaacaagcctcttgataatagatttactgtaggagctgtggtggaagaaaattcctgcaggtggttcgaacagaagtttcctagaggaaagcctcctttggaatatgtccaggaaagtcatagcttgtccttgaagtcaaccacattatgccttccatttgtccttctcacagggagcttttgagtctgcccctcccctcttcactatcgcctcaagttcttctaaaattcagactacacatgaacagccttatgatttctttttattgagggaatgttttatgtggagagagaagatgagttcgtatacagttaagcttatttctagacaaagaaaactaaaaaataatgatagccatcatgcattatttatttactgttctaggaactatgctaataatttcacatatattagtttatgtaattaaaacagagtcaagcagtaaatgttattcccattttgcaagtgatgaaactaatatttgaagacaacattgaagagctggactggtgtataaatctaggcatgaatgcattcacaaattttattttagtactttttgtcatacattttcacaatacttggaatacaacatttgaatgttttcagttacctcaaaactaatctaactctaagttttccagtcgtatttctaccctacttggtatgtaaatagtatttcattttaccagtctcacgaagtaagtcaatatcacttttcctcctggtattgcgataattaaggtatgaagcataatttgcatctggttctcagtttgcctgcctgggactcagatacttcctcctttctccgcagttcactctgactcttcacattgatttagatctaatgctctgttaattgcaaacaggagcctgttcacagccatttgttgatagacccaattttggagttttgctgtcttgagctgtcttgtctaggattatttccccaaatttacgatgacaatttgtagtattttacttatataatgagccaaatatgacaactgtatttgtggtgccaaaatacttcaatgttgaagtctatgtgctgagcctttttgagattgaccaattagaattcattctttgtcttacactgcagttctttaaagatgaaacaactaactgaagtctaagaaaattagccatttgtcagaatggcattcaaggagattagttctaacaattgattcatttaaaaatcaaatttttctacctttttaccagaatagattttgtttgtttgtttaaaaacaaacaaatggaattcaaggagataatgaattttaaaagaaagaagaaaggaaatgatattttgaaataattgtacgtgataggttgccatttgatacttacattctttatatcacagcaatttggtgggaagccgcagcaccagcagaaatgatgttagagaactggtttacttaactaaatatcgaataatgtagtgctttctttttggcagaagataattggagaaaaatatcatgcactgaattcaagactgtttataggacgtcctcggtggaaacttttgtttgatgaaatagcaaaatataacagagggtaagtactatacctcaaaaatttgatatgtggctaataaaataattaaaatattttcaaataattacatgaagtttgaaaatgaattggcaatgagtttaccaatgacaaattcactgaaacactctttcactatcaaaggaagaagtaaggcaggtatcgtcctacatttttgtaattccaaataattaaagtttggcttagaaatagtctacagtgtatttatgagctaaactctcctatctgattataaatttgtataggcctatattaaaaatgggtattcgctcccacagcatatatcaggtgatcctaggaaaagttttcaaaatcatgtttccaaacaaagaattttacaattagttctaacaatgaattcatttaaaaatcacattttttgtacctttttttaccagaatgaatgttttttgtttgtttttcaaaaaactctctgcattgtaatatgcagtctttaaacctagaatatttccaaaaatattatttagaaactataattttataaagaatcttgttcttatggactacgtgtctatgatctgaagaaattactaagaaggaaagcttccatttcagggcacagaccagccagcccatttgtcttttgtaaatttatcatagtgcagagcactgatctataagaattctaagaagattttgaaaactatataaccactcacgtatttttaggtttacatctaaatagtttcatcataagtttacacagttgtaaaagatgtgatttctaacatattgcagatattgacattttgtaattaacataatttctttaaacatatccactggaatataaatacagctagatgatactgtcatttattacaaaaatacataaactcttcttttagcagttggatgttttacatcattctttttctttcatttaagttgtatttctgtcccattaacccatataattttattaaaattcaatttatttttacatttgaactaatcatatttttattgctaacctaatcctaatcatacttctgcaaaaagaatgaacataaattaaatatttcattttaaaattgcctgtaatcataagactctagtgttaatttttacttctggcttgagttatcatttcaattactttatatagttgaacacttcataatttttaaaatatatttttataaacatcaaaaggatatttgattataaatgtacaggccagcttattaaatggatattttttaaaaaatccaatttaggaaatcatggatgaatattatttattgaagaaatcactgattcaagatgatccctatctctaccttcaaagattttgttttagaagttacagaatggaggctgggaagcaaaatttatgaaggaataacgttacccatgtgattcagattacagtcatgtttaaaacacttttgtagtattacccttcccttgatgaagtagttttgggatgaagatgtaagcatgatttacaaagcagaacttttttgtaatattcagagttgaaatttagaaaaaaatgatttcaacccacttttggctatcttcctttcccatctttctccagtatcacccatcttagatgtgataatcttgtcatactcatctgtctcttgctatgcattgcagacatgttcctctttagtgccatttactgacttctgacaagaatttttttgttgattttcactgtatattgctgaaaactgatagttctttggctgaattcagaaaccaaatccctaaagagcagattatttacagggaaatagattgaggctgttggttcctacagttagttctcaagaagtctcatttgttaggctgtttgtgttttagagcgatttgtgtgtgtgtgtatatatttggtagtttgttctttttctggaaacaatggaaaactggtttaagaagagcaaatgtgcaccatctgctgttgacattttgtacaacactttgactttgtgtattggttctcaggcaggtgcctgaaatgtgtttacattttctgaaggatttttatgtagcatacttaggaaaagaatggatcaacattcttcaggtctcattaactggacaaaggcactgtgtaaatggatggtttcatttacaatgtagcattttgattaacctcatgcacacaaattgctgaaaacatatagagataacagtagggaagacaggcatataagttaagattttaaaatatcatgggttgggcaacagtttttatctttcagaaagtgattacttattaaaccagtaggcattaggttagtatactatgtagaatacaaatttaaattgcattaaacccttctggcccagaggtaatgactggtaactcttcgttatgtattcttacagaagcttttgtaagtttgtgtgagagtgtgtatgtgtacttatgaaagtatatgtaaacatatgtttgtatgtgtgtgtgtgtgatatatatttaaaatcaaaaccttagttttttaacaaaaattgaatctatgacaagtaattcttcagcttactttgttgtttttgttgttttatttttttcttggctttgctaggaagaacgagctaactttttaatgatgtgcttcttttgatcatggacaatttctgtataattgtacctcaaagtattctagagtatgaataacatgactcctactaccctaattctttatatttagataacttatatttctttacagttaaaaatagtgctgtggtaattatctttgtacatactttctcatgtgagagtattgcagtagattaagatctttgagttggaattgctggctcaacaggtatacacatttaggtactgctctacaaaaactaaaagtcagaattaatttactttccacatgtgtgtgacagtcattcctttcttttgttgctttttttaaattcagaaattgaattatatgatggtattatatgatcatggaaagtgaaggagctttgggagtcaacctgccttcatttttattttacaaatgaagaagctaggacctcaaaatataatgatttatcaaaagccatggttaatgagccagaatgcagatatgaacacaagtctcctgactgcaagttcattgtgctttacagcagggcatagtcagcttgtcacagataaagagtggcaatcttattttaccatgttccccttagatgggaggtagggaggtgctgcaagaaattcccatgtttactatgaatgctgtagcagaatgttaactgtaacactaaaagaattaataactaattattttgaaatagagatattctaaatattacattgtaaaccatttagtatttaataaactattagaaaattatttattatatctaacccaaacttggtttcctattgtttgtaattaaaatgtatatcctgttttgagctgtgaagtttattcatgatgcaaagagagaaagaaaatttgaactttgtttggctttttgagtagagaattactactctgggattgggtgaaatctttgagattatatctttattttactgccttgtagtgttttcaaacaatacaatttaagaataactaggtttagtctctcacatttactcctgtgaccctgagtcaagtgacttctcctggatctgtaatacaacgagtgaataagctctccggggtgattaagttctcattatgtaagatcctgcgtttacaaatctacatgaaaaagcaagtatgaacatttatagaactagtttctaatgtctacccccaaaccacattttcttagtacccgaatctacctccactcattccatcaaaggtctagtagacaggtctccagataattgttggattgcagcattctaatgcaaatttagtacaaatgaattgcaaagattccttgtagaattcgaaaaagaaaaaaaaaaaagtaagatttcattaagttagtgagagtgacattagggaatcctcaaatcgcacacacacggagaggatatcagagagttaagctagttaataattgcaaaagaaaatgttaaagaaacacaaaaatcataacatcctgtgtgatttaaaaataatgatttttattattatttattttataattaatacttgattttattatcaagtatttaacaagggcctttaggaaatctgaaagacttgccaaactaactctataattgccctgtcaaagccaagcaagaaaataatggtatcttattgccatcatatggcgttgacagaaagtttatacaaagaaataaaatgactcaattctcttttcattttaatggaagctacattatgtttcaatagtaatttaaattttattaagtataacatcatttattttcatatatttttatttcttttgctcactttgggtttaattagctttttttaatttttactagtttcttaaaatggaaacataggtcattgatttcagactgtttttcttaataaaagtgtttaatgctatacattttcctctaaacaccacttttgctaaaacttatacattttgatttgttttcattttcatctcgttcaaatattttttattttttatgttttttctttgacccatgggttattttaaaatgttgtctaatttccaaaaatgaggaaattttccagatatctttttgttcttaatttctagttcaattgggatttgatctaaaaatgaactccttgtgattctaatcccttaaaatgtattgacacctgttttattgcccaggatatgttcaatcttggtgaatgttccatatgcacttaaaaagaatttgtattccattattgttagatagaacattctacaaatgccaattagttccaataggttgatagtgatgttcaagttttcaatatgcttactgaatttctgtctgcttgtattaattactcagagtattgaaataattaactataattatgaatttatctgtctttacagttccatcagtgtttgctttatgttgaagctttttattttcagtgtttaaatcatttacatttaatttaatgaaaatacagttggctttaaatctagcagttcaccattgctttgtacttatctatttgttctttctttgttttattttctttttttaccttgatttgggttgaatttttttttataattccacttttttctctaatgttagccatgcctctgtatttttttttttttttctttttagtaattgctttaggttgttggttcctgaactggattccttggaccagcatcaattggaatcttgttagaaaagcaaattcttgagccctatccaagatctgccaaatcagaaactagggatggggagacctagctatttgtgttctatgaagtctctaaaatgattctgatgaagccaaaattaaagaaacattgttctaagtttacagtatacatcattagcttatcacagcctattttattttttatgtttatgtttatgtttattttttagagacagagtattgctctgttgctcaggccagagtgcagtgacatgatctagactcactgcaaccttgaattcctgggctcaagagctcttcccacctcagtttcctgagtagctggaactacagttgcataccaccatgcttagctaatttttaaaattttttgtaggaatgggatctcactctgttggccaggctggtactttgaataatattgtaacacttcatgtacttccatttcttccatccgttttgctatttttgcattcatcttacatatacatatgttatagttctcattattagtattttttgttttagacatctagcatatattaaaaatattagaaattagacaaaataaatattttatatttactgacagattttactattttggtgtccttctttcctttggttgattcaaatttctatctaattttattttcctacttcttgagtagttttctttagtgtcctttatagtgctggtttgctgacaattctttcaggttttgtttgtatacagtttttattccatcttcatttctgaaaaaatatttttgtttggcatcaaatttgcttgttatataatagttgatgtcttgatttatattttagtactttgaagatatcacttcattgccttctgacttgcatagtttatgacaaaaagttcactttcattcttatatttcattcttatattttctgttgatgatttgtaatgtgtcttttctcccagtctgtttggttttatgtttttctttttgtcactcgtttttagtattttattatcaattgcctaggtatagtttcctttgtgtttattctccttgagatttaatgagatcttttatttttttttttcttctcccttggtcttctctcatgttggactgcagttacatgtatttttgactagttgttttgactagttggtattgtcccacaggccacttatgctctgttctttttttttttttttttttcagtttttttctctgtgggcttcaatttggataatttctaatgctttttcttcaagtttactttttcttcagcaatgcctgttcttttattaactcatctagtatatttatcatttcaaatattgcattccatctctagaatttatgtttgggccttaaaaaatattccatttatcatctcatcatgattatgcttttctttaaatatatgaagcctgtgtatcatcactgcttcaatgaccacgtctgtcatctctatcattctgagcctgtttctgttgaatgccctttctccttgtattagtttgctagggctaccatagcaatataccacagactggtggattaaacaacagcaatttattttttcatagttctgggggctggaagtttaaggtcaaaatgcaggcaggactggtttcctgagatctctctccttgacttgcagatggctatgttcttgatgcctcttcaggtggctttttctctgtgcatgcacttccctggtgtctctttttgtgttcaaattacttcttataagtacaccattcagattggattagggcctaccctagtaccttcattttaacttaaattgcctcctttaaagccttatctccaaatgcagtcacatcctgaagcactgaggattagaacttcaacctacgggctttggatgggcagacttcagcccataacactcttagttatagttcatactttcttgctttttgaattcctggtacttttttgttgatttctgtacattttaaagtttaaatgttagttgccaaattttgatttatttattttaatagtgttggacttgttctgacatgcagttaagttactcgggttcagtttgatctttacaagtctcacttttaagatttgttagtggaggtccagagcagccttcagtccaaggctaattttaccaatatcccctctactccttgcaaataaggtgatacgtttctgagaatacaacccattgccctgtatttataggactttctattctggtgtgtgtgaatacaaattatttgcagtcctgtgtaaactctggcaattatttgtcctgttgatctctgatatctctttactcacattcatgaagtttcttatcatatatgaactgattattaatcaaagacttgaggattctcctctaccaatctccgaggcgtctttctgtggatctcccttcccttccatattctgctccacaaattccagctgtttgggccttaatgtaactccgttctttgtctcctcagtgtagtcaccaatctttgctggagtttcccctgtctgctgcagccagcagattgcctccaggcaataagcaaagagagtgacggtgcttagcttgttttcttcccttttctcagggatcatagttccatgctacctattattcagtgtccgaaaatacttatttcatctattttgtttgctttttttctagatttttaatgtaaaagggtagatctactccctattaccccatcatggctgcaagtaaaattctattttcacagcttttagtttcatttttcaaggtaaaaagttttaataactttttttcagtatttactattaatttttggtaccaattttaatggattcaatgtcttttgttcagtgcgagttattctgacataattaagacatactggattttcccaagatatgagatgaaatattaataattttgacatcctaggaagaatcaaatacaaatcaaacttgggaagaaggtcaatttgaaatattatttatttcctgggatttatttagtctatttgttagagatacgtattatttaactactaaaattttatattagagaataataaaaactgcttgaaatttgttaccattattgcagtgcataaataaaaaagaactagatgaatatgttttttgttttactgtgaatataaattagccacttaaaattattatttcaaattggtaatatcttttttctttccttccttattcatcgctgcttttgcaaatccgtgtaggaattttagataactatgtgtaaagtgtctaataaaagaagaatgtacatagttcagtgtggactgaacatctattcagaagtcacctgtttagcaattgacatctatcaattgctgctcttaatgaggttgctggtttcaccaatgacaagtcatgaaaagactaaggcaaactgataaatctctacctgataataagcatatttgtgctcataggtacattctttgaattatcctaaattctagaatgaaaagtatgaggtaaataaaatattttcctggttgacatttacatttggaaataattagaaaattgttttcaatatgtaaaatagcaagaaatcaactttgttaatactttaaaccatgctcataaagcatacttcttgtcatgttctgcctaattttacacctgattttccattttctctgctcttgttctagaaaaacagttggtgttttctgttgtggacccaattcactatccaagactcttcataaactgagtaaccagaacaactcatatgggacaagatttgaatacaataaagagtctttcagctgaaaacttttgccatgaagcaggactctaaagaaggaatgagtgcaatttctaagactttgaaactcagcggaatcaatcagctgtgttatgccaaagaatagtaaggttttcttatttatgattatttaaaatggaaatgtgagaatgtggcaagatgaccgtcacattacatgtttaatctggaaaccaaagagaccctgaagaatatttgatgtgatgattcacttttcagttctcaaattaaaagaaaactgttagatgcacactgttgattttcatggtggattcaagaactccctagtgaggagctgaacttgctcaatctaaggctgattgtcgtgttcctctttaaattgtttttggttgaacaaatgcaagattgaacaaaattaaaaattcattgaagctgaaattccattttctgtgttgtgtataaacagagtagctttaatttgcaagcactccaggcaaatatattagatgtttgaaaacacagcacaagactctgtattgatacgggtactttgtgtcaatatctaatcgtctccactacttatgctaatacctctatttgatatctgaagactatatgctaactgaaccttcctcaaatgttgttatagtatctatttttatatatttttttctttttattcctctctctagggaaatatgccttcccttagcatgcattagacataatgatttaataggtccctttcatcttcatttaaatctatcactattgcatggtaatgaaaatattcctactataaattataaagggatatatatatatggatatatatatgtatatacacatatatatatacacacacacacacatatatatatatatatatatatatacacatatactaataacttttcccttttttcagcatttttgtctctattattattattgtttttttcccaggtagggtttgtcttaggctgtagcctctaaggatagttagttaatttgcactttgagaccaaaggacatcatgtgtgtcagtagggactgaatataagatttatctcctttgccacacattggtttatgatggagacattgaaagtctagtcatattcctgaacagtaaaacctgtattttaccttttaagtaagaggaaatatgatattcttattcaaacttaagtttagaatccagaatattactgtcgcactttttggtatcctgagtttccatagggaactattgggtttaaagtcaccgttggaactacactgtgtgatcttataaacttatgttccctggctatcatattcttggctcagaacaatatttcccattactatcttaagaattaaggcattcatggctcacgcctgtaatcccggcactttgggaggccaaggcaggtggatcacgaggtcagagttcaagaccagcctgaccaagttggtgaaaccccatcgctactaaaaatacaaatattaggcgggtgtggtggcgggtgcctataatcccaactactcgggagactgaggcaaagaatcgcttgaacccggtgggcggaggttgcagtgagccaagattgcaccactgcactccagcctgggtgacagagcaagattccatctcaaaaaaaaaaaaaaaaaaaaaaaaaaagaattaaagcattcatacagtttagtgattttgtttagtagtcggctatcaattgctatcaaatataacactgctgaaatcagcagtgtgacttaccttgccattgttaaaatgttacataaaacataacatgatagatgctaaggcctttttttgctataattcaccaatagcaatcaagcatgctaacccatactgaatgatatttacttgtagatatttcttcctttccttgaaattctcctttctatggaaagaagatgaacccaaaaaagtgataggaaatgtggaatgctcatgcagatttagctctgaaggcatatttaataactagtatgtcttgacaacagtctttagattaaaaagaattttcatggaaacatttaacagaaagaactagtaaaaagacactttgagttagtccaggcttaatgtgcaatactgactctatactgatcataatttatttatgcgatcatattaatagacctaatttcattaaaacaggtagaagatttttcaaaagaaagatgatgtttcaaagctggtctgccattctagatgagcctccttgcttatttaagttccagtaggtgttcaaatgttaaatgttaaacataggtcatctttgcttctgcagggcttcatcttgcatgtttaagagaactttgttttattttgagggattatttctctggggatcattcttataatacaagccttaaatcactaattttagtagcaataaatgttaaaattgaaatggtgtccttgaagtttctataagctcactataactttggaacaaataaagcagcaacatttgttcacaagatgatgcaagtctaggaaacacactctgcttgtcaggaattagcatttgcaccggccgtggtggctcacacctgtaatcccagcactttgggaggccgaggcgggtagatcacttgaggtcaggagttgaagaccaacctggccaacatggtgaaaccccatctctactaaaaatacaaaaattagccagacatggtggtgggtgcctatagtcccagctactcgggaggctgaggcatgagaatcacttgaaccggggaggcaaggccgaggttgcagtgagccgagattgcgccactgcactccaaccctgccctggaaacagagtgagactctgtctcaaaaaaaaaaaaaaaaaaaaaaaggaattggcactagcatgagaagccttaggaatctgagttctggaactatcaatgttgtcacaggctaatggtgtaactaagtcaaattacttctcatacatagactaaaatgtatcattttattaatttttggatagtgtatccttttgagaatctgattaaaatgcttagcatgacatacagcacatccctacaattttggggaacctacaaacacactccagaaagaagcacatctgtttaagaacctctaaacaaaatggctattgctataggtctttctactcatacacttcttttctttttctttttttttttttttttttttttttttctgagacggggtcttccagccacactggcatgcagtgacatgatctcagttcactgcaacctccacctcctgaactgaggtgatccttccatctcagcctaccaagtaactgggactacaggcacacgccaccatacctagccaatttttgtatttttagtagagacaggggtttcacaatgttgaccaggctggtctcaaactcctgggcttaagtgattctcccaccttggcctctcaaagtgctgggattacaggtgtgagccaccacgcctgccccaaactaccaatttctataggattataccaagacatttattttgtggacaagggcattctctttatatgttcccaaacagagaattcaataggactttccatcggtttttaatcttgctgtatcacctgatttatgcaagggaaggctataatttttaaatataaataattctaaaaaactatgattcatacacacacactcatacatatatactacataaatccatacatatacatacatacaattgggacttcatttgcttttttaaaaatttcaagttaaaagtgaaatgcttgatagttcttcattcagtgatgttaaaatgccagttgggtgactgtggtagtataggcatttaaaacaacagcataaaagcaatgtagacaaggaacagggtgaatcaatttaatctacacagccaagtgattgataaacccacaaatcagtgtttacttggagcattcacagcgggtgatggatttaaattatgagccattgttaaagagattcactggaggcaaatggactgttgtcattaacagataatgctagtgatgaagaatactcattatataaaagagaagaaattttaagaaaaaatgttttgattcttaaggatggttatactagccaaaaagtgagttttctaaacaaaccaaggggaacatttttaagttgctattcactttaagaagtttccttttcttatgctagctaggactttttccatatacagttatattgttgaatataaaatactgaaggtaagagtagtcttattttacgattgggaaaactgaagcccaaaattgctacaagtcatctattgagtttgtagcagagctgagactggaattcagttatttttatttatttatttatttatttatttatttatttatttttatttatcttttttttttttgaggaagagtctcgcagtgtcgcccaggctggagtgcagtggcgcgatgatctcggctcactgcaagctccgcctcccaggtccacgccattctcctgcctcagcctccggagtagctgggactacaggctcccaccagcacgcccggctaattttttgtacttattttttagtagagatggggtttcaccgtgttagccaggatagtctccatctcctgaccttgtgatccgcccttcttggccttccaaagttctggaattactggcgtgagccactgcgcccagcctggagttcagtttttttaatctcttctaccgaaaggctcttcacctccccatgaaatcttcatctaataaaaatatcttgcgctgtgagtttgaatctccctgttaaaccctatttagtgccatgtggaaaacatgatactgagtgttaattccagattcagattcagaaaattatactcttcttacgaatctatcttcttattctaaatttgttagtcttgtatgttttgcctattaaaaaccattttcatatacctgtttttaagtatgataattgtggtaaagggattgtgatctccagagttttgcattggagaaatctgtaatagtgtagtttctaggaaatgctaataatataattttaaattcaagttcatagatgaaaattataacttcgccagctttctaaccacccaggaaaaactggtgtcaaaacaaatgtctattgttcactactcacatgaccataactcactttttgtccaggagaaaagagtcagcattttgtaaactagtgagacaggaaataaatgaaatcaaatgtaatgagattggcatttacttcagccacctcaggacaatgagaactcactgttatttctcttctaaatttcctctctattgcgctaactttattattctattctgtaagactctttattctattctatactattatattctttattctcaaaggacagaattgcaaagactagctaaactaagttttctaaagagaaaaagcagaaaacatctaattaggaaagaggggtttattataagagaaaaaaaggccatgtggatcttttataaaaattagcagaaagtttaatgttgctttagaacggagaccaacaacctgatgcaaagtgttaaaattcacattttggaactaggaagggcaagaaatgtctcataggaggaataaaaattgtcagagaaagcaaaatcatttaacacttcaggacgtaataatgtttttccttttataactcaaaagatgcttaaatacatggtaaactggctatttctctggtttggaagaatgtgaaagaatgtgatgtttggctagattttagggaacttttcacattttcactgacattagaattttagcaagaaactttatcttagattaaaattacatctaggttctttaagaaataaagcattgacgagctgctatttgacctagagaagacctcgacacttagatgagagccagcactgcaaaatactcgaatatacatagcaataaagaaggccaggatgccatgcattgctttagtcacatacacaatgcattaaaattctgtcattgctaggtcatatttcacaaccgttatcctttcacccagggaatgaaaaccttcttaacaattgtagacattgagatacacacattgtctctgttgtaacataaaagtatatatatttacttataacagcatattcacttgaacctagtatcaatttagtatgactatgtaattcattttagtggtgagaaatatccacagtgcataaaatgggagctttgcttactggcttaaaaatttactgcagccaacacattggctaaagacaaagctgttaaattttctaggtttttatctgcagctgaacctcaaaggaatgtaaaataccttactgcatgtatgttggaacatgacctgggacttaccctacactctgtgattagatgtgctgcacagtttattctttagattcccagggactaacaggtttaggaaaatacaatctcttcagtcagtgtggcatgtttaatggcagaactgggtgcccaccaggtgcaattacacctttatttaaatatgacaattatctgcttaccaaaaggcattagcaggagattatctttttttttctctctcttttcattaaaatttattttaaggccaggcactgtggctcacgcctgcagtcctagcactttgggaggctgaggcgggcagatcatctgaggtcaggagttcgagatcagcctggccaacatggtgaaaccctgtctctaccaaaaatacaaaaattagcttggcatggtggcagacagccgtaatcccagctacttgggaggctgaggcaagagaattacttgaacctgggaggccgaggttgtggtgagccaagcttggccattgcactccagcctgggggacaggagcgagactgggtctcataaataaataaataaataaataataacaaaaaaaattaaattagaggtgggaaaagtagaaatcactttaaaaattaagcatacaattggatgacatgctgttctaccctgagagcgtgccagtgttaccattctattcagccacattcaatggttatggagtaaataggcttctgagagagaaatcagaaaatttggagccttcatccctgaaatatattagaccacttacataaaaatgggaataatatctaccagggatgtagtatggcaaaaatgtggaagagggaggagaagtgtggtgaagagagagatttcctaggcaaatctcccttagtagacttttgatgacagagtaaaaatcaaacactgttgtaagaaagtaaaactcaagcttttatgagttgcagtccattgtacctgaaagattgattatttaattttattttctgggcgagtagagaaacacacacagcaaaccagcaccactgtctgtcttcgttctgctccccacaaagaaagtcttttgttaaatctagtatatgctttctgaattcctcttagctagttttggtcgggcccaatatggatagagatagttgtactgacttatgaaaattaacttaggagaggagccaagatggccgaataggaacagctccggtctacagctcccagcgtgagcgatgcagaagacgggtgatttctgcatttccatctgaggtaccgggttcatctcactagggagtgccagacagtgggcgcaggccagtggccctgcgccagccgaagcagggcgaggcattgcctcacctgggaagcgcaaggggtcagggagttccctttccgagtcaaagaaaggggtgatggacgcacctggaaaatcgcgtcactcccacccgaatattgcgcttttcagaccggcttaaaaaacggtgcaccacgagactatatcccacacctggctcggagggtcctacgcccacggaatctcgctgattgctagcacagcagtctgagatcaaactgcaaggcggcagcaaggctgggggaggggcgcccgccattgcccaggcttgcttaggtaaacaaagcagccgggaagcttgaaatgggtggagcccaccacagctcaaggaggcctgcctgcctctgtaggctccacctctgggggcagggcacagacaaacaaaaagacagcagtaacctctgcagacttaaatgtacctgtctgacagctttgaagagagcagtggttctcccagcacacagctggagatctgagaatgggcagactgcctcctcaagtgggtccctgacccctgacccccgagcagcctaactgggaggcaccccccagcaggggcacactgacaccacacacggcagggtattccaacagacctgcagctgagggtcctgtctgttagaaggaaaactaacagacagaaaacccatctgtacatcaccatcatcaaagaccaaaagtagataaaaccacaaagatggggaaaaaacagaacagaaaaactgcaaactctaaaacgcagagcgcctctcctcctccaaaggaacgcagttcctcaccagcaacggaacaaagctggatggagaatgattttgatgagctgagagaggaaggcttcagacgatcaaattactctgagctacgggaggaccttcaaaccaaaggcaaagaagttgaaaactttgaaaaaaatttagaagaatgtataactagaataaccaatacagagaagtgcttaaaggagctgatggagctgaaaaccaaggctcgagaactacgtgaagaatgcagaagcctcaggagccgatgctatcaactggaagaaagggtatcagcaatggaagatgaaatgaatgaaatgaagcgagaagggaagtttagagaaaaaagaataaaaagaaatgagcaaagcctccaagaaatatgggactatgtgaaaagaccaaatctacgtctgattggtgtacctgaaagtgatgggaagaatggaaccaagttggaaaaccctctgcaggatattatccaggagaacttccccaatctagcaaggcaggccaacattcagatttaggaaatacagagaacgccacaaagatactcctcgagaagagcaactccaagacacataattgtcagattcaccaaagttgaaatgaaggaaaaaatgttaagggcagccagagagaaaggtcgggttaccctcaaagggaagcccatcagactaacagcggatctcttggcagaaactctacaagccagaagagagtgggggccaatattcaacattcttaaagaaaagaattttcaacccagaatttcatatccagccaaactaagcttcataagcgaaggagaaataaaatactttacagacaagcaaatgctgagagattttgtcaccaccaggcctgccctaaaagagctcctgaaggaagtgctaaacatggaaaggaacaaccggtaccagctgctgcaaaatcatgccaaaatgtaaagaccatcgagactaggaagaaactgcatcaactaacgagcaaaatcaccagctaacatcataatgacaggatcaaattcacacataacaatattaactttaactgtaaatggactaaattttccaattaaaagacacagactggcaagttggataaagagtcaagacccatcagtgtgctgtattcaggaaacccatctcacgtgcagagacacacataggctcaaaataaaaggatggaggaagatctaccaagcaaatggaaaacaaaaaaaggcaggggttgcaatcctagtctctgataaaacagactttaaaccaacaaagatcaaaagagacaaagaaggccattacataatggtaaagggatcaattcaacaagaggagctaactatcctaaatatatatgcacccaatacaggagcacccagattcataaagcaggtcctgagtgacctacaaagagacttagactcccacacattaataatgggagactttaacaccccactgtcaacattagacagatcaacgagacagaaagtcaacaaggatacccaggaattgaactcagctctgcaccaagcagacctaatagacatctacagaactctccaccccaaatcaacagaatatacatttatttcagcaccacaccacacctattccaaaattgaccacatagttggaagtaaagctctcctcagcaaatgtaaaagaacagaaattataacaaactatctctcagaccacagtgcaatcaaactagaactcaggattaagaatctcactcaaagccgctcaactacatggaaactgaacaacctgctcctgaatgactgctgggtacataacgaaatgaaggcagaaataaagatgttctttgaaaccaacgagaacaaagacacaacataccagaatctctgggatgcattcaaagcagtgtgtagagggaaatttatagcactaaatgcccacaagggaaagcaggaaagatccaaaattgacaccctaacatcacaattaaaagaactagaaaagcaagagcaaacacattcaaaagctagcagaaggcaagaaataactaaaatcagagcagaagtgaaggaaatagagacacaaaaaacccttcaaaaaatcaatgaatccaggagctggttttttgaaaggatcaacaaaattgatagaccactagcaagactaataaagaaaaaaagagagaagaatcaaacagacacaataaaaaatgataaaggggatatcaccaccgatcccacagaaacacaaactaccatcagagaatactacaaacacctctacgcaaataaactagaaaatgtagaagaaatggataaattcctggacacatacactctcccaagactaaaccaggaagaagttgaatctctgaatagaccaataacaggagttgaaattgtggcaataatcaatagtttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcattctgataccaaagccgggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacgcaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggacgtatttcaaaataataagagctatctatgacaaacccacagccaatatcatactgaatgggcaaaaactggaagcattccctttgaaaactggcacaagacagtgatgccctctctcaccactcctattcaacatagtgttggaagttctggccagggcaatcaggcaggagaaggaaataaagggtattcaattaggaaaagaggaagtcaaattgtccctgtttgcagacgacatgattgtttatctagaaaaccccattgtctcagcccaaaatctccttaagctgataagcaacttcagcaaagtctcaggatacaaaatcaatgtacaaaaaccacaagcattcctatacaccaacaacagacaaacagagagccaaatcatgagtgaactcccattcacaattgcttccaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatatagtgaaaatggccatactgcccaaggtaatttacagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataatgccgcatacctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaatgatttaaacgttagacctaaaaccataaaaaccctagaagaaaacctaggcattaccattcaggacataggcatgggcaagggcttcatgtccaaaacaccaaaagcaatggcaaccaaagacaaaattgacaaatgggatctcattaaactaaagagcttctgcacagcaaaagaaactaccatcagagtgaacaggcaacctacaacatgggagaaaattttcacaacctactcatctgacaaagggctaatatccagaatctacaatgaactcaaacaaatttacaagaaaaaaacaaacaaccccatcaaaaagtgggcaagggacatgaacagacacttctcaaaagaagacatttatgcagccaaaaaacacatgaaaaaatgctcatcatcgctggccatcagagaaatgcaaatcaaaaccactatgagatatcatctcacaccacttagaatggcaatcattaaaaagtcaggaaacaacaggtgctggagaggatgtggagaaataggaacacttttacactgttggtgggactgtaaagtagttcaaccattgtggaagtcagtgtggcgatttctcagggatctagaactagaaataccatttgacccagccatcccattactgggtatatacccaaatgactataaatcatgctgctataaagacacatgcacacgtatgtttattgcggcattattcacaatagcaaagacttggaaccaacccaaatgtccaacaatgatagactggattaagaaaatttggcacatatacaccatggaatactatgcagccataaaaaaggatgagttcatgtcctttgtagggacatggatgaaattgaaaatcatcattctcagtaaactatcgcaaggacaaaaaactaaataccgcatattctcactcataggtgggaattgaacaatgagatcacatggacacaggaaggggaatatcacactctggggactgtggtggggaggggggaggggggagggatagcattgggagatatacctaatgctagatgacgagttagtgggtgcagcgcaccagcatggcacatgtatacatatgtaactaacctgcacaatgtgcacatgtaccctaaaacttaaagtataattaaaataataatgataataataataataatagtaataataataaaagaaaaagaaaattaagttaggaattgcagagggtagcataagttatcccacttatttaagatttaatggaggaaaatttagatgtttatgagatgttctgctgaattaaattcaagacctatgtcttatcactagaaatccttctatttacaaaaatgcaagacgttttatctgctttttttttttttttagatgggaataaagtaaatgtatagctttcttactcttactggagatatttttcattatgggttttcatcaaatctcatgttatgttgtagatttttatatttaaataatgtgtgtgtgcatgtgtgtatttttatggtggattataaaaaaaactcgagtgaaaatgaaattctagaataatgcttagtaacaccctccagctttcatagcattcaacaatttcgggtttgcagttagagaaagtgtagtcctctcatccaagtgtgagatgctcagcagtccaggtttggcatttgatccttgttatctagttaaatggaagtgtggcattatacaatgctgaagagaaagcactaaatcaaattcaatattcataaataattgaaaatatgcatatatttatatataatcttattcctataaagtcatagtatgtataaagtcatagtatgtaggaaaacctttattgctttagaacatgacacggtgcttacaactgaaacaaataaaatttgttcaaacatacttaaaatctcttttcattgggaattacgcacttttggcaataataatcaagaattttctctaggattttgagaacagcatagtgttgttttcatcctaaagaaggatcagtcttccatgtgaagataataaaaaagtagtatttaagaactgctcctttgaaacactttgaaagtgttctaatttctaagtcactcaacgcttctgtaattttccttacagcaggatatgtaattgggaatgataggattctgatatttaaatttaacatgctgggtttgggattttggttttattttggtttgttttttgttattatttttaaatctcataattgtgctcagtaagataggaacattaaatatttatataattttaaaatattaaatatatatatatttgcacagaaaattaataaaacatactatgttcattatgaagtttaaatgttgagtgtttatgtttgaccattgaggagtcaattttgcctaaacattgagtgtaccgtacatatttacacacatgtaaaaactcctgcttacagatttttgtttattttatccagcacatcataatctcccttttttgaaatattcaaattacgtaaaataaagaataatagtagagttactgtcaagtaacatttacctgacatttaccaaggtgggatatgaaccatttgccataagccctgtcctagagaccagtgttctgatatcatctgaaaactacttttcctgtcagtaaaatgcatatcagatttttttctaaaaatgctctctgagaatcattatagcttgtgtttctatgttgactttgactctcagtagaattgataattttatagtggataggatgagtaaaaatgcttcagtatataggactgtgggcacctttaggtcctaagatatgcctaggctataccaagttgaaatgcattcctgcatcagcagcatgaacatatatttgctggttgggcatggtggctcacacctgtaatctcagcactttgggaggccgaagtgggtggatcacctaaggtcaggcattcaagaccagcctggccaacatggtgaaaccccatctctactaaaaatacaaaattagctgggcgtggtggttcacgcttgtaatgctagctactcatgaggctgagacaggagaatcacttgaaccaggcaggtagaggttgcagtgagctgagattgtgccattgcactccagcctgggcgacaagagtgaaactccatatgaaaaaaaaaaaaaaaaaaaagaaaaagaaaaaagaaaatatatttgcttcagaatacaagacattatattattgatgtttctaaatatatgctctttacattaaattattagccattattttcttttagagtcatttatggattaaattagatgccactgagctctaacttacagagcttttagaagtagtgacttgttttgtagggtttaagcaggttacttcactatgtggtactgcatttttctcaatcaattcctaccatattgcagtctttcaagtgatttattttcaaagagtctgctttcctgagatggtgtcttgccccatgtatttcaccaagctgtcatacattctgtaatgggtatttcaataggtcaagttcaaatgcatttaaaaggcaagattagtagttatgtgcttgcattcgctatgtgcactatttgctttgtgtcacaatggggtcatgagtgtatgctttaatagcacaagtgttgtaaaattactcgtcagcagcagccagcgagagaataacacaaaagataattggggaaaaaatatttgaaggatgcacaaatcagagaggcattgatgcaaatctcaattctgaagactaacagtttctctgtaatgtcttcccttattcatattgattcacctgtcaggaatgtgtctgctagggctaaaaaatatgaaaatgtgtgacagtaaaagtttctcatcagactttttattaggcaagaaaatctctgagaaatctttacaagtggcttgtgttgcagaggccaagtttgcagcttgctgataaatgtgtaatcaactgggagatgtaagcatacatgccagaattggctttgcatttcagatatagacccaaatatagtgtgaaaaaatacacttagagtaactgctaattatgacagattccaaatgcacatgcattttcacaaggtgatttctgaaattaaatttgtgttttattttgataaaatactttaatggaggttttgactggtaaataaactcagatttcaagatttttaaatagcagcctctgtgccttggttttctcttacagtgatcgtaggaagtggtttgtttagttatttattttaaatatctaatgggacacttgggaaatattgaggtcatagttaccttatacctgttttccaaagcagattgaaacaaaatatctagtaatatatattatgaccttgtgggcattgttaagccttgtcttttggggcagttgccccttccctttaacccttatctaccagtaacaagaagagtgcttcaaattagagctaacagacagacagagccctgagagccacagctataccttgaagttgtactatgactacatcttttgttttgttttctaatataaactcttttcctcacctatttcctggaacctaactttaaccttgaaccttgtttttccctgttggttaataacccagctacagactttaagacccaaagttcactgccacaattggcaaaaacctatttgtttgggttttttaattaatccaagctctgagtttgtctgttcccaattcagcgcttgaattagcctattatccttgattctgagtttttctctgccccagggctcagaggagtcattgaggcactggccctgcccagtcacagccccttctgtgcccatggttgctatagctcactgacatgcacaatgtgctgcagaacccggtgactttatggtagatagtggttctttgtgtatgaagtgatgtttgaagtggagtcaattctcattatttatggtagttttgttctataaagttgccacacagactgaattagtgaataacaaaccattactctcagataggctcccgtgaacctatgatcaaatttccatcaaccttttaatatataaccttgtatatgtgtgattctttttaaagacaccttatttaatatatattgttgattaactaacattgaactcatccctggacaaagtttatctaccatatatatatatatatatatatatataaaatccacaagacaaggagatagactttttgttttattctgacaaaagactttaatgggaggtccttaggaacactaaacaaaacttcactacacttggggctcagctgggaatgtcagcctggagagacaaatgtttggctgctctgctcatggctgcaaataaccatgaaagtgcagcaggtattaatttggggggtcacaaaaatttttagcaagcaggtgatttgcaaatatggaatctgcatataatgaggcttgacagtatctattttttctagatgtggtaaatgggaaggaagattctgcgactttttatatctttagtttttattcttcacttactggttttgaaccaacttcggcatttctgtaggagacagagatgcttttctattttgattggtcggcctttcctctcgtccctttctttcttctgccttcaagaatagagaataataatttggacagggtgtgaaatttttattggtccacatttattaatagctatgattcttgtgtgtaaaggattacacatatatctgtgtgcagaaaaaaattaatacaccaggcctgagactgatatccttcttagaaaagtgtgcttgcaagcttgtctcttggctggcatttgggaacttgaaatttcaggacaattctgattaccctaaatgataacaatgactgaatgttacaaaacttttgtgcaaacaataaggtttatactgaacacctttttttctgggactctggaactttgataagtgctgggcaagatgcctatgtgatgaacctccaataaaaaccttgggcactgagtgtctaaaagaacttcctttatagacaacacttcatgcatgtcacaacttgttgctggaggaattaagtgtctcctgtgcgactctactgaagaggactcttggaagcttgtgcctgatttcccctggacttcaccccacacactttatccctttgctgatttcgctttgtattctttcattgtagtaaatcatagctgtgagtaaaactatactgagatcttgagtatccttagagaattagtaaacctaggtgatactgggcaccccgacacagtttgcgtgcctcttagtaccttcatctctcattgtcttttgtccctgggagaaaagtggatgcaggaccttatcccatattctcattctctcttccatttcttctatgccatacatatgctagactgtcaatgaggttgctttcatctttgttgtacttcttttctctctttgccttcctttcacaatttgatagactaagggtggtaagtgccccagatttggagtcatttttttctaaccattgaaagtttcacttgagactattgcttaagtcttgtgcaccaacctagctttagcagagaaccccaaactaaagttagtcactgacatcgctgttaatagaaccttctctcccctttgcatattgtttactgtatattcctctgtcagttccctaacacaaaacagaggtgattggcagggcagagttaaaacattataatatcaccaaagccctaatattccttgcttttttctctgctcatttttctactcaacccatctcctcccatctttttccaaagtggattgtggtagatgtcatctgtgttggtagaattagcttttccaaagtcttctttcttgtcttagtaatctttcctgcattctccaatctatctcatttcattgaatctcatgattccaaccttaacctagacaacaggttatattcctaggaaaaatagaatatacctcatcacctgttctttatgatgtttttatatactaccagtgatgagtttttcttccagtctttatttttttaaattcagaataaacggtttaccggagacagcaattttaaggtcaatacatgacacagtgatgctgcttcaattgcttgtccaggagcttttaggtttctgtcaagatgatggctgatgatttcttttaattgactttatagattgatatctttctggacctattgaattccagaactgaccatataatgtggtggttacagtttcttctgagacaaactctctaaaatgtaaagtcatactgctagagttaaaatcctgcctgcatcagtgtgagctctgttaccttggacgatgttttaaaaatgattatcagctttagtttttttatctgtagaatgagggttacatgagtcaataagatgtaaggcgtctagggtcacaaagtaaattctaaatgctattaataatgataattttactaattagacaaagatgaatttgaaagtcaaggaaatagtatggatagcacgaaggatgaggatgtaaaatcaggaatgtatgattaaaagtcctggtctctccattttactagttgtgtgactttgagaagttctctgttcttcaagtgtcctccttattaaaattgaaataatatactcatgtccagtgtgtatatgacaactatatgtcaattatatagtaatagtgattgaattatgtctaacatagaaaagatagaaaggcatctattataataattatgaaagaaattgggccaacctgaggaaataatgtagtgaactatggataatttattttttctatattatgaacttatttacgaaagtgtgtttttaaaatatttttcagaagtgattacattttcattataatttcataggtatttatcagcttgcctgtcacctccagtaagtgtgcgtttcttcaaagtagtacatggttttagagtcttaatcatcttttcacccctgagttctagcaaaatttctgattttcaataagttctcagtaactggtaaattaaatgtaattctcattgtgttgttatacctaaaagccatgcctaataggaaatattgagtattgttaggggtacttagaaccataaaaagaatcttaatagttttccttaaaaatattataaagaaaaactaaatagaaacagttaattatgtatatgatcaacacgttactttttagtacttaaaaattaggtaatagtctatttagagaaaagactagttattggtctagttaaaaaaaaaagaaaacttagggaaaaaacagactttcaagttgaatgtgaattttgatttttcctctctattatttatgtcactaagtcctcttaattttctcattttgaggtttctcacatctgtccttttctccttccatggccaccatcctagttttagagataatttaacaccagctagttaattcatttcctaatatagagcagcattaaattcaagactactaacattagactactagcaataaaaaaggttttttccatgggtacttgtaaatgcttttcataaaaattttaatatctatagctcctggtcttcttttttacttaatgtctgtgcctacactcaaaatatttttaggcatcagctaagtatgtaccttaatgaagttttacaagatgcacaccccggtgacctgtagttgtttgacgggcaggagagcagggtttcttttctagaaaagctacattattatcaaaggacacaaacttaaaattctcaacacactcttttggtgttggccttcaaaccttgatttaagatataccagtcatttgaataactagaaagatcagtttaaatgtaattatttccttgatttttccttgatgctactaccagatacatatacacacattaaacaatcacacacacctggcggtaatctataccaacacggtatattggaaaatctatgaacttaaagccgtaggtttggatctcaatttcatagtggcagtatgactttgggcatgctactaagcctcttagcatatcagtttctttatcttgcaagtgacgataataataaattcacaaaattttagtgacaatgcaatgagatcaaatatgtaaaatacccagatcttgatacatattataaaatcctccctaagtattaagtccataaaatctttcatctttcataactcttcttctatagccctaagccaaatctatcatatttttataggttgggagtataaatatttcttatatttcttcctaggctgaaaccatcttaagggccagaacttctttctagttacttctgtagccccacatatcttagcctggtattctaatttcaactcatgtttcgtccattgatatctgaaaataatttttttgaaccaaactatttttatgaattattccagtattgcctattattaataacttttctttatgatctatcatgctatggaagctctgatggaaatgttcaccatctccatctaagaacattgtcttttagagtcactgaaagatttatcacatcagcatgccttcaactcgtactgaggatttttctataagtagttcccacttctcagtgtcaccatgtttaccagtttgagttctgtatttccttttagttgaagtattacctagtttaatgcaacctggacttctttcagagctatcagcaatcttcactttttggaagtccttgacttactgaagtgagggctagatcttattgtttgttaagcataaaatatgtttattctgtttttacttttctctatttgcttagatttaatttttgatgagtttcactgtcattcttccgtttaatatttatcctattcttactatggaccagacattgggaatataatttctcaaaattaatgcagaatttatcttcatgaaatttattatctagtggaaacggattcattgaatttacttgccaaagtactggaagtaagttgcagaatagcatgaaataaaactggaaaggcaggcaggggctaaaacaggaggtctttgttgaggatttggaatttaactggagagaaatattaagcttctgaagtgttataagcatctttttaaatggtcactttaattgctctgtggattagaagaaggcaagtgggggagttagaattaagttaagtggctattgcagtagtttcaacaacagaagattatgacttagtctagaactgaaatagagagattgctgtgatgtgacagtgagggcacgttagaatgaagtagagacatgccaaagtgattgcatattgcaggcagaaataggactactgcaaatagattagatgtgtgggaaactatatctgagaagacttccaagattattgcatgagaaataacctgggtacaggtgccatttattaagttgtggaagtttggatgagaaagtaatttttttcaataatttttaggggtacaagtagtttttgattacatggataaattgtataatggtgaagtctgggttttaagtgtacccctcacccaaatagtatacgttatacccaacaggtaacttttttatccctcaccctgttcccatccttccaccttctgagtttcaaatgtccattacaccactctgtatgcctttgcatagcatatggcttagctgtcatttattagtgagagcatatggtatttggtttgttcctgagttatttcacttagaataataacctccatccatgttgctacaaaagacattacttcactgagaattgatatttaggatgatagtaagagttcacttttagatgtgttcagttttaattcctgtaaaatatttaagtaaatttttaaataagcaattggatatatcaatcagaagctctaagatgaagcttggactagagatataaacttgggagtcatcaacaattctggaattttagaaaagaatactttagcaggaagtagaatagaaagatgagagtgataagatcatccacgtgtagtggatgctctgctgtactgaacagattgttccttaaggaccaaagcattcatttcccccagctactgttactgttggctgctgattgctcatagctgagtccctcttcaagaactgtgctcacagaagggagtctctggcctgagtctcttgcctggggcagctcaaatgcaatgactagacaatgtgggaaaacaaatactgaagctcctggctttgatgtgggacagttctaaaagaccatcccaactgcagatagctgttggatcacctgagacttctggggaacctgaagactactggtgcccaaagtagtcttaggaagcattctctgaaataggattttgctgctggattatccaccagttaattggcaatgaaaactccatcactagtagtagttgaaatacggatagctcctagcatgacatagtgggcaattgttaaaaactttatcagtattaactagaatgggcttatagaagaattgaatgcacctgtaactaaagcataatttagggatttgggaagttcaaaggaagtggcttttgttgagtgctattgatacattgatgctgaaaaatgacaatgaaagtttaggggtgactaaaatgaattgtgaacccaagggatctacaatttaagctgaaatgtggagcttaatccattggaaagtcttttaaaaagggttttgacctttctttgtcaaagaaactctcacctgtgcattagctcatgtccttgaggttctagtttcagtcagcttatcttcccttcctgtttgttctacaaaattcagactggtttagtcaacccctataattatgtgagacaaatttcttataaaaagtttatacatatgcttatatgtatgtttatatgtttgtatatatattcatatttctcctagctgcagagctccccatagggtgggctgaagcctctactacattgctttttctcttcctttcactccgtacttctcttacgccattagagatattagttctgcaagcatttttccttttcttcttttattatttcctttatttgaatttttatttatttataatcatggaatagaagtgcaatttttgctacattgacatagttcattgtggtgaagtcagagccttcagtgcattcattactggagcaatgtgcattgtacccaccaagaaacctgccattgtccatcctcctcccactcctcaaccccgtggattcctcattgtccatcattccaaactctgcgtccatatgtacacattatttagctcctacttatgagtgagaacaaattttacaaacactttctaaaaactacctgcatgcaaacatctgccttagagaacccaaactgaaaaaccttcaacatctagagatagaagagttgaaccttttggaaatgccaagaaggaaaaagcagacaggaagaaaatgcctacaggtgagttactgcttagaaaccataaggaaagagtgtttatgtagaagagagaatcaagttaaatgagtaccaaaaatgtcatctaatttgtcagtatagacacctttggtgaccatggtaaggaaagtttccatagagaggcagaacagaaaacaaattgaagtgtgttaagtagtcagtaaaagacatagcagtaaagaccacaaatataatcagccttattaagaagcttggctatagaaagaaatagggcaaaagctgagtggaaactcagcttttttttattttggcctttcttggtcaaagaaactctcacctgtgcataacttattttagctcatgtgctattaatggagagtgatttttcttttttaagttaagcatatctgaatgctgaagcattaaggaccctacagtatgggaagggttgaagacacagggaagaatgaggaaaattagtgaaataaaaactcaggaatttcagaagggttgggttcctgagcttacaaagagatgggtgttccataggaaggacacttaatggcaacagtgagtgatatggtttggctgtgtccccacccaaatctcatcttgaattcccgcgtgttgtgggagggaccagtgggaggtaattgaatcacgggagaaggtctttcccatcctattctcgtgatactgaataagtctcatgagatctgatggcttcataaggtggagtttccctccacgaattctctctcttcctgccaccatccatgtaagatgtgatttgttctccttgccttcctccaagattgtgaggcctccccagccacgtgcagctgtgagtccagttaaacctctttcttttgtaagttgccacctctcaggtatgtctatatcagcagcgtgaaaattgactgatacagtagggaataaaaagatcaataaaacaaaaatctaggaaatttgtagattttctggcagaaaaaatatttaaaatcccacataccttattcatataattcagtgtgtgtctgtgtgtgtatgtatgtctgttactatatctatatctacatatctgcaccaaagcactttatatctttaaaataaactggcaaaacagtagaataacaaaaaccctaatcaactattgttttctcagttgttaaggtgaagctctttttcatgattttttatctacattgatctatcttcacctaatctgaatttttctgatttggtttatgccaggggtcagcagactttttcaatcaaaggcaagatagtaaatactgtaggctttgggccatatggttgccgttgcaactacttagctctaccattgtagcattaaaacatcaatagacgatatgtaatgtaaatgaatgagtttggctgtgtttcaataaagcttcatttacaaaaacaactgccaggcaggatttagcccattagccatagcttgtcggcacttacctttgctcatgttatcattttgctcagattatcgatcacctcatctaccttgtgaacttccaggaataccattcaattattagcttttctttgaaatcttctatagctcccctgatgatactgtacccctgcagtattaattatattacttctataagacatggaatattcctttatgatggtatttataattttgcaatgatttgctcataggcttttttctcagagtactgtgatttcactgtgaatagaaactaaatcttattaacatttgtatctctagcaaagtgccaagacagagtaggtgttctataaagacttgttccttgaatgaatgagtgaatgattaaaaatgaaccaacactctctagctcagaggagtttatcctgatagggactcttggccaaggatatgcactgggttcaagcccagtaccacatcataggtgctttaatagccaacttttgtttatgagatagaagtctatgtacttgcatgattaatacttctagtccccaaatgtttctctgtcttaaaagtacatttatcataatatcattttattaaataggtacattactattcatggtttgcaaaattattattgaaaaacaaaatgtgtggttatatttttatctttctttcttaaaacaggtaacatgttgagttaacatactctatgagaacttgtgaaataataatatttatgcactactgtaaaggctttagatttactcttcaggacatgctgaggaaagtactattattacatgcattttaacaatgataaaactggggcacacagaggtaggataactcacagaaggttatacagctagtgagagattgaaccaggaatcaaattcatagagtctgacttgagatcccacatatgttaaaaattttctcaaatccttcatgcacttaatatcacagcctatgccatgttaaattcacatgaagttaaggctctaacttaaataaggctcttcagttcccctcaaagataattgcagcatgtcttctttcttctaagttatttatcttttaattttctcatttattctttctgatgtcctgttttttagactcttttctttgcatttttaagtccacacaacccttttcaaaagctctgtggcagtccattagaaaagttataaaagtattcatgtgcttttacccagagaacctactcctggaaaataacttcagataaataaaatggtatatgaaccaaggtatgcattacaatattaaacaaaatgatgacaacagctaaatcaaaactattgagtagcaaggagttggttattacacttcaacataattgagtaaaatataacaattaaatttataataagaagcacctaggaataactaaactcaaatccaagataaattgcctaaactactgagcagacatgtaaacttgggaaggtgtttaccctatttcagccagtttcctcccttgacaatatgaatagtacttattcacatgttggtaacatgtcgattgttaaatgagttaaaatacatgaaagtgcctagcacagttctttgaatatcacaactactgactaaattgtaacatctttgttacttatttctaattgaaaaactagaaatcataagaatatgccttataatcatgattatgaaacataaaaattggaagatgaacatgaagtcataagagtaatttcttacattgctattaagaaaactcataaaacaataagataaacatgaacaatatagaattttggcaagcctttctttaaaaaaatacttaaattcttcccatattgttttaagtaggtgaacaatttgaaagctcttgaggtctaagtggcttccatagccaattttaattttcattacattgtacaaaatggcaaatgattttgaaaataagcaataaaaagtttattagaaaatcaaaactcttttcacatttgcatttcagcagctttcagaaggcatctaatcagagggggagtggaactttgttttactgacatgtcctccaaaacaagctcacaataggtggccccagttaggccgtttttatgatgacaaagaaatcccacaaaatcaaagcctacacaaacaaggaaaaagctaaaaacatctgccactaatgccagttgttagcctgctggagacactggctgaaatgacttgtgccaattgcaaatgtgatttctacagatggagaattacatatttgacttgttggaaaggttggatactaaaaatactttttttttttttttacaaaacacagaaagattaaaaaaagagtagcagctgcttatttctcttttttttccaacagaatgtggcttataatgtagcaatggaaaataatcagagcagaagcataaaatgaagcaatttgtaaaggtctcagtaaaaaacaaaaccatagaatataatgttgattataatttaatggaactgtcagtttgaaatatcagtcatgtaatttctgtgccatattgagaaaaccatggagttaaagtgatgatggtttcatcatagatgttgcttttatacaaatagacacctcaagcctctagagaaacaaaatgatgttctatattgaggtgcggtgatggagggaattgcctgtgacaaaggaaaaaaatgactttatatggctccctctcagtaacaatgacaatttcttaggtggacttttattcaaaatgtgttgcaaaaatgattgaaacataccaccctggactaaaatcttgccttcaaatcattcctagataagtgacccacacatagttgttttgcagtgtccacaacaccttggcccctgttaggtaagccagacccacccacatgtgtgatctgtgactaaaggtgcccccaatcaccgttattccttcttcagagtcttctacagactattgtgcaaatttcttttcccattccttcttgctcttcatttaactagcttcaattcccatctataattgactctaatcctcagacaccattgttaatgatcttcttgaaatcttttttgctggttatgtactgagttgaggatatactccctggtatttatcgtttcctcccacagacttccactgtgtccatgggtgctactccccacttcttgctagattttcctgcagtcagtatcagaaattagacatgctagcttaagtctgacaactaatgagagtcagaagatgactgctgctctattaccaagtttagtaactgttcggaatttctgataattaataagataacttcagaaataatcataaatttttccttattgtagattttaaaattaaccaaaatgtgtggttaggacatgtgtgtggttaggacatgtgtaaagtaggatgatatttgcctctctttgaaatctaaaatgggactaaataaaaagtaatcatttgaaaattatgtggtcttgatttttaggtcagtcttatacagataaaggtgtttccaagagctcaaatttttcagacaatttatttttaaatgcatttataaactatcagaatgctatgctgcagaacttttagtagttatagaatcttgtgactgaaaggtacctcagaaaaacctgtgtgtctcgtcttaactaccttcccagagatgtagggctcagatgccagacccagagaggtttctaggagcctggattgagtaggtctgcctttaatataccaccaagggacagagaaagtatggtattcaaagatgacactggaaacaaaagtagtcaaactgagatactatttgaaaatcctaagcagacaagcacaactaggtataaggaaactgaagagactgggaacacctggacaaagtaaattaatttggttggaggctgaaagaaagaatggtgaaaacccctaaaataatgtggaagagtaatagggactttttatagagcatggttaactttgctttacagtggggagagttggtaagaaccctgagccaatttaaataaagataatatagactcactgcttaaattttctctatagattccaaatcaaattagccacccaatccagtatgtgaagacttccagtggtaaccacttattattgtccaaaggtgtccattttgattttgtaactctgagtattgaacaatgtttccccttattgaactaaaatgggcccactataacttcttcccactgatcctagtcttttatgctatgcatagccataatacaaatgcaatatcaattttactttttttggaaatcaatagggccccaaaatttaagtagtaggattatctgaacattctaatttgaaatcttaataggcgaggaaaatggaaatgagttattttactagaactacagaaaggctaatattcagataattgttcaaacttcaaatgtttgattgcattttaaactttctctaataagatactttttaggaggtgaaaagatgttaatatagttatcatcattaaaatatttaatggacacatcttgagacaggcacttagctggatgtgttatagacgctgggcccttgttctcagtgaccttaaaaaatatcgtcagagctatgacaggaaagagctaaaggttcttttctatttgaagtccataatgtattttggagcagaaatgtaaaataaaggggaatatcatcctttctgaagaaaataaaaatgtgtttctgaagcctaaaggagtcagttaatgtagatttctcactgttttattaaaataaagaaggggccaataaaacatatatagatctttaaataatcagaaggcaaaaatcaaaattatttcaattttttaaaataagagcactttaattcacatacaaataacagttcctcattaccaaatagcatcctttccttagacatatgggcttaggggaaaatgttaaaagggctgagtgaaaacagcaagacaaagacaggtgtgttctacctgagttggaagaaggctacactttgtattaggttacaattttgcaaatggtctttacagaaaaataccagcagatattctctgggaacctggacattactttgagttagagtgaggtcaggctttttggccctactctattgcctaagccttttataaatggctctgatacaagctgtggtaatcctctttctccatgaggagtggctgcttttcttcaggaagctgctttctcttgtgacgacacagcaagctcacaagccctgccagcagggcagtgaggacggcccctaccatcgccgccccaaggagccatgaccagatccgactcgcttgttccaaataggacttaatgtagtcttgaaaagagtctgggtctgaaataaaaagacatcccattgtttttattgttaccaccattgttacgatcaccatcatcttcatcctttcacagtcctttggagtagacacctgggtttgaaggccagctctactacttattaactgtaagagcttgggaaagttacacctaatactccaaagcctcagtttcttcatcagaaaaatgggaaaataatacccctcttgttggaacgtttgaattttatagataacatccgtaagtgattcagggcctggtatatagtgtgtactcaattaaatgttagctgtgatttttccatctttttctgtgaaaggatgttgtaactattccgattatcaatagaacaccgttatatcattaaccattcactaatccagtcttttaattatttgacagacattaatagtaatgttggcaaatgctcagcaatcttagtagcctcccaagaaccctagggcatttgaacaatctctgtattcacagaggtcacagtcttaaatcttgaaacagattttggcgcatgggcaccgtccctctgtcctaaggcttcgggggttgggggcgctcttggttaccgggccgcagtggcataggagtgggccctgtgccgcggtaccctggagcgtccgcactctgggcctttgtttctcctcagagacgcactccctgctggagggcaggggcctggcctttataggcctcaggactctgaaagtaaagcctggaggggcggggcttaggggagccgatatatgtaagaataatagcccttcgggtctgccaaaatcaaacaacaacaaccaaaacaaacaaacaaaaaaaccccaaaagcctgaaatgaaactacagtgcaaaaaataataaataattttaaaaagggaggaaaaaagaaaacagaatgaaaagggtaaaaaagtcgaagaggcagagcctgaagcatttgtggaaaaactactggatcgaattacagcaaaagggaaggtggagcatttcctgaagtttaagggacgtcagatgttgacagtacttgggaacccgcagaaaatttagattgtccagagttaattgaaacattccttaattctaaaaaacctggtaaaaaaaaattacaaaaagaaagaaagtctttatctgacaatgaatctaatgacagcaaatcaaagaaaagagatgctgccgacaaaccaagaggcttcaccagagatcttgatcctgaaagaataattggtgccacaggcagcagtggagaatggatgtttctcctgaaatgggaatattcacatcaggccgacttgctgctggcaaaagcggcaaatatgaagtgtcttgaaattgtaattgttttttacaaagagagactaagttggcattcttgtccagatgatgaagcttaattgtttgcattgtgatatatatatctgggtcttggcttttaattaactagtgtggaaaaataactacattctaatgaaaatcagttttgatatgttcattttaaaagtagtattgggagagttgggtttttttggtgtgtgtgtttttttttcatcaataccacttgttactttgaacaaataaaagctttctgtagttgcttcctttatcataaaagaacatttgatatcttattcttctatgaacgtattcataaaatgatgtattatttcctctgcattagagaacagcatttctaaatgtcggggaaaatttccatagtcattactcaatcagaacttgcgtttatcctaaggaccattctgggttgtgtgtgtgtgtgtgtgtgtgtgtgtgtgtatgcataaaatgtgtacataaatggctttttgtgttgtttttaaacattcaccaaacaaaaatcatgggtaagcccatgtttttgagatgccatcatactgagcaacctaagaaataaatcacatcaaattaaattcaaaattttcctgaagccatacatttcaaataaaacagatgattctataattagttggacaatttaaatgtatcatttaatagtagccatataagaatccctatctacacctttagtcatataaatgaacagtttgtaaaattcctaaaaggaataattttattactaccaacaacctccccaaccagatgagggaactagacagatcctgctgtgttttaattatctaaacaagacttaatttaatggacatttaacgattcctctagcaggccattcctttacaaaaagttgaaatccctgtgctatactgactaaaaggtaatgattcatgggatgtctaagacttggctttaggaacccaatcagatggttggagatttggcagtttagaatctgctgccataaatggatgaacaacttttgtaatgtattgacttgcatattttttctttaccttaactcattccttacaggtagactcagtcttttcaatattcgattttctggttcagcagaaaccagggaaaacaataacttggtagtaatcagaatgttatccaattgtatattgattcctttattgtaaataaaggtgaatagtggtcaatcgttttacattactttaaaaagcaacaacagattttgaccacatatatttaaacaataattctgaacaaggaaaagtctttagcctcctgattatttatattccttcaaaccacataagaacatggcactgaggagagacagcatccaatatgttactggcttagcatttcctctattatcatacccgtcacattatattccagttatctattatatgaatattttttctattaaaatgactcattgaaggccaatagtatattgtcatcattgatataattctagaatctggtatagtgtctgaaacacatatgagagaataaacatgtttactgaatgactgaatgtgttattggacccagaagatatggtgaaggaatgtccctgaatggcagctgtggaatgagaagggcagacatatacaaaaggatgtcacccagggaaaaaatttataaattactcatatttcactatgttatgaggtagtatttacagttccttttaaaatttggtataaacagtgatgggtgctttaaaatgaaaaaaaaagtcttaattccaatagaaaagtaatgcaggaaaacaaacgtaatcatagcatactatttggttgaactgtaaataatattgtagtagtaaaaacagtaaaattcctagatgtggatttgcccccaaatatgataatactatactgagaagatgaatgaaagaacagggaagctgtaagagagttaaaatcattatttaaatatgaggaactccaaagataaacttgatgaattaacagatagtaatatttccctattatttagaaatacagggcaatatagcagaataaataggtaaaagggttacagtagctgatataggggcataaacattttgttataagacttgcagcactctttggcttgtaaaataacatgcttataatatttgataaaacaaaattaattaaaagatatgcttaacaacttatgtgtatgtggaaaaaagtataagaaaaagtacacaggagactaaaacagcacaagtgatcaatctaacaataagattacagttgatttttatttttggtttattctattaattttccaaaataaaaaaaaagtctttttactgatacaattagaaagcatgctactaaaagtacctgatgcaattaatagatgatataactatatatttaggaaatccataatcagataatgcatagtaaaaaaataaaatacggctagataagtattacataaattaaacttccctatacatcaacaattaacctattgtttctattaaaatggctccttgaaggccaatagtgtgctttcatcattgatataattctagaatctggtacagtgtctgaaacacatatgagagaatgaacatgtttactgaatgactgaatgtgttattggacccagaagatatgttgaaggaatgtccctgaatggcagctgtggaaatgggaaggaaagatttgttttaatgaaaaacaaatctcattctcacaatcaactacatatttaaggcacgtagcagttaaggagagatgtttaaattttatgtaaatataactatagaatctatttaggagactattaagatttgagtaaatgaggaagtccgtactgaatatctgttcagtaagagcaaatggattctttctaacaaaacaattcctttatagaagatgctctctataatgcatatagaagatatatatgtagaacatacacagaagatactataaatttactttttgacatagcagaaagaagagagtgcatcctgggcttaccttgcagcaagtcatggctatgtgactcaagtctagagcaaaaatatatgtataactttgggggaagttcccttaaaaagaaaagaatatatctttaaccatttaccttttcctttctgactagctagaatacagacaggttgttggtgagccatcatggactatataacccagggtaaaccctagaccttgaaagttactgtttttaatatatattaaaattattttgaaaatgggactacaatacttagcttaaattgctgttagtggcttcaatacatagtacatttaaaatgtccaaaaaaaggcaggatacatagaggctacataataaatattttcttttttgttaaaggcttggctgaagtgctttcacagcttttaaatactatttctatgtcagtcctgttctccagcttctcttactattgctccactttaattcattccaagtggtctcaatttttactgtcaccaagggactgtctttgagatacttttatttctcaacatccttcaaattcagactttctttgtaagccatctgcgtttgagccccaatagtgcacctttttgttctgtcccaatatcgtaattttttgatcatccttccctctgtgaagtcctatttttcttgtcatccattcttttcagaataattatgtagatttttgttttatgctctatcatttccaaagtgcattaacatgcccatttattcacaaaacaaacacatgaagtagttaggggccattactcaaatgaattaggagtctgcctggagcgattaaactagacaatgtatgtatagcccttggtacaatgtctaccatatagaaaacaatttacaactgctgttgattcttatcatgatagaatgataatttcatcaatatttcacctaaatcagcttacaatttgagtttttctttccaaacttgcttcagctgctgactcagctccattctcttctggattctcaaactagtttctttgctgccttgtgacatttggcacaaacgtccatttattataattatatctatttatatatgtcttatttttcaagcttgtcacaaactctcaagagcaagtattatgtcttacttgttttatctttcttcaactcatttattaaaatatcacttattcattgagatacactacctgtaggcggggagttggggggcactctgtctcatttaccttttcaccctcagcacctggcaggtaaacaaatcatttcgagagtaatgttgttctgatgaagatagaaagggatcatggagaaaagacttcctacatctctgtgaagtcagggaatgcaccccagaagactgtcccactgagtaaaagaatgaattagactctgagcatataatgttgatggcaatccatcctaggcagaaaagaacagcatgcacacaggtatacacagccaaacagagctattgaacaaattcatgaatgatagaagtgtcatcaaattccattggcagaatggggcactgcagttactgtgaacagtgtttccccttctcatttttgaaaccaaatttccaggtcttttgtaatgtatggggagaaggaagctctcaacagagtttttctgctacgtagaaagtaagattacatttatcaacaacattgaagacataacccttctttgccaaagatttttggcctccccttgtaaattagttatacatatgagaaaatcacctgctactcaattttctaaagaatcactaaattcaattataagagaaaaagtttgataaatggcagacatcagctgcctttttacagaaaccacttaagtaattataaacatgagtacctggttgatgaataataatccccttgaacaaaattatatcaagaaatcttaaataattttttagtaagcttaaaatttagctatgaatagagataaattttaaactccttgaaagtacaacagaggcaacaatatggaaaaattcataaaatagaaaataggcaattggtgttacttagtttagctgttttgttttgctttgttcttagagatgagtcttgctgtgttgcccaaactggcctcacactcctgggcttaagagaacctcctgcctcagcctcccaagtatctgctgttgcttattttaaagtcaaacttctctaaaattaactttgtaaattcaaagccgtgtgaaaattactctaaagcatttcaagtaaattgtttctttaaatttaattggaaataaataccttcaagcttctaatatgactcattgagcctcttctcccctggctcatccaggaaattttgttgcctttgtagtaaaaagtatccattgggacactagggaaggaacaaagaggtggagcatatgcgtagaagacaatgtaggggttaaagggaaccctcttctctgtgcagtgatggagtgatgaagttttggattcagtatttgacacttactagctttgtagtttaaaattaatcactttatctttctgagtctcaatttacttacctgtaaaacagaataaaaatcacccttccatggggttttaaaaattagctgagtcaataatttatatgctgatgtctctcgcattaggatctgagggccagacaccgcttttgagtttcaggctgtgtatccaacttctcaagagacattcaccttgccgtcccatataacttcatttcactgtataacaaaaccataagctttcctccatgtctttctttgctcctcttgttattatatgagtgaattatactaccattcatcattttcacaggccagaaagcgtaaagccattcctaatctccttcatctgatatataaataattttccaagttctgtaaattttgccttcaaaataatatcaaattaatcatgctttctgtctcccttcctgccaccaccactgcaacttaaactacctttacctcttcctcagactcttataatagcattttcactggctttctgcatgtgctttccaactactaaaatttttctgcatactgaagctgcaataatcttttgaaaattcaaatttgattataacctgcttaaaatttatcagtggcttgcattattctaacaatatggcccaaattcataaccatgtcctccttttcaactagttaattctacctgtcatattgatgtcatctgaagtatcacttcattgacccctggagttaggcatatctctatataaatgagtttttcagcaagcagttaagatctttctcttccatggtaaactttgtgaagatagagactatgttgtttaccattgtatccatagtatctaaggcaatgtgttattcaaagtacgtattcaataaatgtgtgtgtaaagaataaacaactcagtacagacacataaaaaaaaacctggtgtgatagaatacttatagtgttttaaaatatatatccaaaagtgaccagagtattaagaggtgtggcatttttctagaaaacttcacttatattagttaagagaaatgacacttcatgataaatatcacttgtactcaaactgatttattgatttcagtccataccagatacaatgtgatgcttagaatggagaagcttgcaagataaattctgatcttgggggtttggggaagaataaaacccaggacagattcatacacagaaagaaatgctatgtaactatgagaaaggcgtgagtaaacatcactataagtataaaatgatttttatatctgagagtttgacaaatggagaaagagagtcagaattcaggcagaaacaatagcatatttaaaagcatgaacccatgaaagtctagcgtgttttggaaatggaaacagacactaaatcataaaatcctaaatggaaaatctttgaaaaatagttaccaataagctcccttttttatgtactgtggttttcatagaagaaagagaagacatgtcacttgagacttacaggaaacccctcctcttaccacacctccaccctttgcaaatttctctgttcttagtgatcttaagattttccaaaaactgatctcctttgtcagctgtgttagcattttgtgcattggctacagtcttcagataaagcagaaaagttcaattaaacccatatcttttcaattaatcatccctcaaagggcagaacaaggttgatgacctatagcctctcctgttagccccaaattgtgtatatattataccatatactaggtaagtggcctgggaaaatcaatttatactctttatgactctgtttcctcatctatgaaaaagcaaaagaaataatgatacctacttcatagagtaattatgaagatttaaggaagtaatgcatagggcacattgagaagagttcctggctaataaaaaatacttagtatgtgtgaactattataaactgggtcaacttattttcttcgtgtccttttccactgttcatactactcaaatagaataattcagcatttcataaatatgctgtacattttccacctctactgttcttgctattctctttgcctagcatatcccctgcccttttctatctgccacctgcttattcattctcaaggccttgttttctctttttaggttgaacccttcaaaagtcatggctttctcttcagcactgctgtgggattttctttatgactcttttactgcacataacacagcctgatgttttttacttccttgcacaattgtcttacttccacactggagcttcttcaggtatgaaactatgctagtcatgtatcactggatttgagcacaagagtgagagggttgagtttcattcgtttattttatatatttatttatttatgtatttatgtgtcattatcaatgaatgcaatgaaacatcaatgcttgttaaatacctcctacccataagccacactgtttttgataattaaccctcatgcgttaggtgaattacagtgcggtgagatgaggaggacctcctagaattgaaatcttgcttctccacattattggtgtttgattttgagaaagtcacttaaattctctgggtatcagtgtcctcacctttatcttaggagaataaaacttacctcctatatggtttattaataatacatgtaaagaatatgcatgtagtggactttcaggtagaaggaaacactactatctgttcctcattttgtcaagaagatactgacatggttctatgcaggaagattatttagagctcaaatctaattctaatcctggggttttatattactatcgtcatcatagagcaataaacattataatagctattattattaactacacttaagttcaagatttctacaaattttcttggtaaccctagcaagaaacttccaaaaatgattccaaaactgctggatgtttaccctgtgttacactgtactaggctcattaatgtatcattctaaataattctttaatgtgttctggtcccagtatttcaggtgaataaactgagattcagggatgtagagcgaatttcccaggtcaccttacagtcagttgatagagtcatgtctcaaaacctttttttttcttcttctgattctactgctcttcacatggttgccatgtacaaaatggcctatgttaagcaaaatgaccatgactttaaagatcctcagaatttgattcctgtgataataaactggtaataaattaaggattataatgcactttcaggatttaaagtgttcaggaataacattgtcgaagcataaagttttgtgttatctcaaaataaattggtaacactagattcagcaattcctctgaaagaaagtaaactttacctgaatcttgtagatagctatagtcatagcccagatctttggatgaaataaagaaatcaccatttctgtacagtggtataaaaggaaccatgtaggattcccggttatgtccaatgggtgcattggcttctggataaacttcttgaagaggacggtgccttcggagccactgctcaaaaatactgcagaggaaaaggttattcagactaagaaacatattgtgtataaaagaaacatttgaaaatttttaaagtaaaataaggcatatattaaaatctggagacatggaaagatgttgaatatattctttatacttcaaaaatatttcgtaaagtattagtttattctttcaggccttgaagttcactcatttaaaataaatattgaggctagctttgaaaaaataatttcttagcaggtgaataaaacttacacattgagttttgaacctccagaatgctgcaaaataaaggtaactattggttgagtgacaattgagtcatagttgtaaattaaatatattcccaaagaaagaccagagaaagaacgtataaaactaaattggaaacagtgctagaatttggtcatttttttggttctggtgggaggctttcaatgatttaaacattcatgttgtgataggtgaagtgtgggcttaatgagtcttgatgggagacagagcttacctccaatgacaatggtttagatacctaaactttgtttctcggctttttctaaagttagagtatgaccatatgataaatattctgccaatctgacatactcattcatgacttcgaaacaggagatagtgacacaaataagcagggacaatcagaaaccatcctagaaatgggcagtggcagttgatataacaatatttagttttcaggggcagcaaagccagatgtaccagcaaaggaatccattgcccagcaagtgccctgtgttctatagcatggttttggcagccgtcttagctgatgcccttcttgcttattctcacctatttctgaacctgctgctccatgattttgtgagctactcagtagcctctcagcaaattcttttcctacttaaatcaggcagagttagtttctatttcatgcaactaaaaactttgactggaaaaaaactaaaaaattaaaggattgaaaaaagtccagtaagaatggagtagaaactcaagttgtagagtaatttatagagagccattaacaatatgacaaagagaatggctttgcattatcgagtcatatgacatagaagaaagaacacaagagctggagttggggaactcttcttgaggcctagctctgtgttttcatctggctgtataactctaagaaaatcactgaacttggagaattagcctcctcatccttaaataagagtaataatatctgtcctacctgtttccaatatgatagtttttgtgaaagtactaaataataagctatcgttacttagctgtacattttaagctagcaggtcaaaggttggtacatggtagaaaaggtggtattgaaaaagaagtgataatgcttcaaacaaaatgaatacaattttagaaaaccattttcaacattttgaagcacaataatgaagagaacaaggaagccaaatggaagaaatggtgatcattttttccatgacagaaaacaattctgtttattagaggatctgaacttgaacacactacttgtggtcaaagttggttttcagttgtgaatttagtgaggaattggcagtccactgataaacactaaaaatctggtccatgcataccaaatgctttctaaattagttcaattattaaacgaatatttactgagtatctactgtaggtcaagttacacaaagaactgtgtaaaaatctgagttctataggttgagacagggaagatttgtaaaattgtatctgtttgatcttctttattctacaaaatgggaattatatttatgtcatgaaggtaatgtaaggattaattaaaataacacaaaatacacagttaagtggtacataaaagctattatctttctcacagctcctctcttctcttcttccccctcctaagtattatgactatactggaaaaactttaaaattgatgagacataacatatgctgttttagaaatgccaaagccttgcatatgtgagcagtgcctttagtgatggttagtattctgataggcaaaaatgagaaattagaagatttaagaagatgagtttttctgtgcttcagtttcctcaacagaagaaattagaaactggcttgacaataaaccccaaattttattaaagtcctatgattttataaactagtccttttgttttaacttttatggttttcttctctacaaaagcagtacttgtttgttatgtaaaatagagaaaatacaaagaaaaaggagaaaagaaaaaatcacctgtaattgctctatgcttttgttatatctagtttttaaaatatgcatccacaacactctacctgtattttaccaaaaaaggaaatcacattatagataatttttagtagacattttattcgtactaaccatgtgttttcaattggtaaattaaatttttaaaatgagaaggaggctgtctgataatccctccaccacccctgtcaaattttgactgatttgggaacagcctgatatacagtgagccactaaataagggctggaggcaaaaattgtaccttttgtcaatcgagaaaaattacttctatagttcaatttataaataatcttgtttctgccatgaaataaaaattctttacctaagtaggacaaggacatcaattctcagcaccaaaagatttaatggatgaaaccattaatgtgctcacccacctcatcaaccttttcaaatgaaggtattaatcttgattaagttcttcaccagtgattctcaacttcagttaatttcaccaaaccatgactagaatagctcacatgggaatattaatgtttaactcagataattacattgacatttggggaggagggggtagtcatctttttagcaaaacttaatttgaactgaatctagatagtttttctgaaaatctgagtgacagtgaaattcacaacagaaaaattagaaaaatgtaaagatgaacacagatggaaatatggaaagatgtgttttataaataaaagctggcatgggacctctgatttcaggtcagacatgtaaagactctggtcacccttatccttaaaataagaacaaaatagacaaattaataatcaacaaattttcttggacccatgagagaattgaagttgcggggcaaactgccatcctcaaaagtggagagatgggttcatccagaggtacatagctgagatctgcttaccaggggcaggagcagctggattcctaaagtggtaggaacactgaaacacttcgatgaatggctggagactgagtctagactagtgaagatagtgggaaattcctgggtgctgctgtcttaggggaacttccacatgtttggggctttacctccaggaactccaccaggtttttatggtgaagacctcagaaagatactctccttactctgttacagggaggaggagagtgaccgttgtgaaatatgcccaggacattctccatatcaaagccctatgatccaggggaaattgttagagccttatcccagtttcaggaagagaattcctttcagtccagcctctttcagtcttcctgtctcacctaaggggaagtaaatataagccacaggggtcagagtttcaaggaaataaatagaaatactgcaaccagggaagcaaatagaggggcagaggcaaaagaagaaaaagctgtattgtgaagccccaatgcactggcctactaaaggactaagatttaattagaatattttgaacactcccctctctcatactttaccagcatccaacaaatctccagtataacaacagtggattacagctaaaagagctgaaatacatgaactatctctgaggaagagtatgtagggaaacccaaaaccaagaatagagacaaaaacaaatacactagagaaacttgaggcctctcatctcaaaactgtaacaactaggacaaacatttaaacattgtgcaactccttgccaaagtaacataaatttgtacactaaaagcccatttacctcagtttatcttacctaataaaacatatggcttttaataaaaaattacaagtcatggcaacagagaagaaaaaaaatctgaagagataaagcaatcattagaatcatttatatcatattagatatgatataaattttggaactatgagacatagaatctgaaataattgtgaataatatcaattttaaaaaactatacataatataaaattaatagaataacatttctaatagaaaaagtaaataatatgcagaaaatcatgaataatgtaagcagaaagacggaaaccctaagaaaaaattgaaagaaagcctagaaatcaaaaacactccaacagtgttgtatatatcactaacattgatatggccaagaaaagaatcagtgagcttgaggctaggttaggagaaacttcccaaactgaaatgtaaagagaaagaataaaaaataattaagaattatgggataatttccaaaaaatgtaacatatgcataattggaatgccagaagaagaaaaagtaggcagaacagaagaaatattctccagtaaagggaactggggttcctcgaagaaacggcaggttctagggctggggtaagaaatatacaagatgaatgttgagcatcttttagtgccataaactaaggatatgttcaaagaaacgacaaccacccacaatgttagagatatttcaaaggaacagagtagtcaactgaaatcactcctaaaggctaaagctggaagagtttgagccacaaaataaagttgtataaaataaatatagaggagtctgtacagatataatctataaatatacaaattaataaatggagagaaatatataaatctatcatgtaaaagaattcaaataattatgtagatactctgtcttgaaggtactatatataactccccactcactaagtatgagatgcacacagtgacttcttttcaaagagtgcagtataaaaacatggtgaaatcatttaacagtttgagaaacttgaccaacactacctctgccaggtgatcaaggttaacattcacaatggtaagttatgttaatagcatagccctttttgggtgatagaggtgtgataattgctctctacccatcataagggtcatggccaacactcctataacaaaagacagattaacaaagaaaagcataataatttaatcaaagttttatatgacatgggagacttcagaaaagaagagccaaagacccagggaaaattgtttattttatgcttagattttatgcttatggccagtgttgcagaaatttggacaaaagagtatgatctaatgtaatagactgagagaaacaacccagtaagccctgtctgtttgtattcttcttgacctctctgtgcagcagtccctcctcctacgtatagggcagggccttagcaatgaaggttttatgacctactatcaaataatgtaggtcagagtatttctttatggccagctgctacaaagaaaggtgggagaagatgatagtaatatttttagggtttatggcttgttttggaaaagaaaggttctagtttttatgatcttggggaagagggagtctagtttctatggtttatttcacaggagaaagaggggccagagactttgcttctgaggccttccaatctcctttacttcaaaatactcagcatcacaaggcaccatactttggggtacatttttgagtccctctacacctttgatatgatgtgaagagaatggtgctttacctctagggttgtccatcccaaaacacatatcccagtttaatcatgagaaaaaaatcagacaaatatcaactgtgggacattttacaaaatacctgagcagtactcctcgaagttgtgaaggtcatcaaaaaaacaaagaaagtctgaaaaactatcacaggcaagaggaacctaaggagacagaatgattaaatgtaatatagtatcctgggtgggatcctggagcagaagaagatattaggtactaagtaatctaaagtattgactgtggttgataataattatatcaacatggttctttaatgtccactaatgtcccataccaagggaagatgttaataatagaggaattgggtatggaaaatgtaggaactctccgttctatcttcacaacatttttacaaataaaataattataaaatatttacttaaaaaaagaacaaacaaggaagccttaagatagttggatatttgggaactgattcgttgtaacacatctaccaccaccatgagcacacacaaaaaaaacttacatacacatatgtaatagaagacctttttatttatttattcattcatatatttaaaaaatgaatgaatatattctaaatatctataataaactggctctgggcccagcattggtgaagttttctgccctatagtatttggagtctagtggtggagatagacagtaactagcaatttcagaaatcaacctatagttatggactggcaaatatggaagaatgtaacatggtaacaggatttaatggggaagcctcatctggtctgtggcctgaggaaaagtctttgatggtgcattcttcaagagttgaagaatgactgtttagagaaatggtagaagaatatttctgaaggacagaatggaatttggaaagaatctttgattggaagtatgcgacaaattcaaggaattaaaaattgaccaatatgtctatagggatcaaggagcaaatagctccagatgaggctaggaaggtgaactgaggccaaatcatgaagggtagcagaggccatgttagggagatttgtgtttttttcctaacagaaagtcactgtttgtatctgggaaggtgaatgataacacgaacagattatcatttgtaaaagaccacacagatttcgttgcagagaagggactgaggaagagtaggagttggtggatatgcacgcatcagggggataaagaaatcagtgagaaaatgatgtccaggaaaatagatgatgtctggaaatccaagcagtacaactgaggggccaggtaccacagaaaatgcctacttttctggcttatgctactgagcaaagtgtttgtattaccagatgcagaaacccctgaagaagtggaatattaggggaggatgctgatgtcatgattctagatgagatgtgctgtaagatgtttttgagacatttcagtggggatgtcaggtcattcgctagatatctgggtctggatttcagagtaagattaactttggaaacacaaattgagaagtcagctcaccaacctctagctgataactgaagccatgggaataatgagataatgaaaatacaagagaatctggagttatttttcttggatatcatctttctgaaaggccaggacagatgacgtgacaatcacactctctttgagaactgcagcttgcgatgcctccagccacacgaatttctagtcactcaaaatttattgaattgcagttgtataatagcaaggccagtgcattcctaaattttttttcttttattattatttatttttttcatgtagtacttgttttgaagcagttacttgttaaaacaaacttgtaatttttaaatgataataaacatttccatttaaacttaatccaataaaactctctaagcctcagtgtgctcatttatagaaaagggatggtactatctattttaatgtatttatgagaacaaaaataaaataaggaagtgaaatgtcaagtaacaatagttaaggataaaatgagacaatataaatgattggcttagttctgaaaaagcagtaatttgttttcttcccttccaaacccctcattttacagaggcaaaataaaatttgaatccaaaggtcacagttaacggtacaaccaacattggaatcaaggggtcttggctaccactctgttactaataatagtaagtaccctgttctctgtgtgtttacacaggatgacaggggtgtttctgcagttgcaagtatgcatatgcttctaccaaagtctgatgtgtagattttctctcttggaagacgctctgcttgaccttcatcttgaaatgtaagctgtttatccaacagacacctgcattaattagcattaaacaccttaagtgttccttttctcagaggactcaggactcacacactttatactcaagaagcagcaatgaatacattacaagatcaggaaaggatatgtattagcataagaaatacaacgaaggagataatgtgaaatcatactttaaaaaaaaaggcagagagagagaaagtagtgaacaaagttggtaagggactgagttaagatgagaacccagttcttctgcttctttctctgacactttagtgttccctatctaggtttctgttctttccttcctttctctccatgaggaggtttctgttactttctgactaagttttaagcgatgcagatggaggagaatttgtcaactgggtgggaaaggtacagaaaacagatgctagattgtcagttaaacatgctccttatttcagaaattcaggatcacaatcactcttttttctttcactgtgagggaacaaatccaaatagaggcagaggcattgttgttttcaaagcaggcacaagtacattggaggaatatcaatgctgccaaccagctgaagaacaacagctttttatcttttgtttctcagtgccttgcacacagattaggtgccaactatctacccaataatcttgagtttataatctaacccagatgacaaagttagcaataaagcaatgtctataaaataaactcttaatatattgttaaatcaactttagctgaaagttgtctcctacatattttaagttcagcctgaaggtttctctgtacattgtgaactataacctaaatggagttgtaaacagactatagtctattcttgtgccaatcaccgagttttgtctaatcaaaggtggccagctgttcaaaccatgttcaaataagtcaaacaccaagctataaccaatctgactgtttctgtacctcacttccatttttttaacgttatttttctttttctgtacattaatcttcttccaccatgtggctgtgctagagaatctgagcctactctagctgaggaagctacctggttcataaattgttctttgctcaattaaactcttttaaatttaatttggctaaagttttcctttgaacaatatcttgcttaatattttattgattccattttacagaagaaaaaattgagtcaaagaatttaagaatttgccaatagtaactcaactagaaagcagtagaagatctggggttccattttagattcctgtgacttttattataacacccaggtggcagagctaggaccagaatcaaggtgctctgttccaagtttaatgcttttccactaacatgcaagaaattagtaattaggaattaaaacagaaaggtggacaaggctttcatgttttgttccaagcattagcaggcctttcaaagctatacacagaagtgagaactaggcatcttctgatttcaccttacgtgacagaatttgattacaaaatctctcagagtatgtaagaaagggtgacggcacagttgtgaaacactaataacagtagtctaaagacatatgatttatccctgtagaatttaaacccttttttattcacaggctatgaggagccaaagaccatcactggcttagtagggtatgaggcggcaacagctaagtaggtcaaagaggatgccatgaacatgagattctggatctggacttagatgtatctatgatgactaacttagaataccctcctgaggagggccacagagtacttgggaggtgactttaagagtgctgaaagggacctaaacagctcacattgacaacaggcagtgaaagtgaggggaattggggaaagccgtacaatatatcttgttatgaacgtaggaagaacctgccagatgaacacaaaagaggggaaagtccaatttccacaagcacaaaggcttatacaaggcatcctaactttggccttgggatgtggcagcaagaagagaagtcagaaatacaaaacctcctcataagaaaacttgtttcaaattcctgttattgatttttgtgaggagagagaagataatctctggaagtctcagtttattcatctgtaaaatgtggataataacaaactttaaagagctgtaagacataaatgagatcaggtactctaagggcagtacttaacatgcagtgaggttagttgtggccattatacttgcacagagcagaagccattagttctacagcttaatataggagccaatttaatttccttagaaaagacattttaagtatttgctatttggtctctcatccaagtactaaccagactagaccctgcttttctttcaagaaattggtatgcctatggtatagacataggcaaatttttgctatttgtgaattatggtgtaccacaaataaaagagttgtcctaaaattaattcaataggtctatgaattttatttcttattttaaaatataaaaagagaatcatacaatctaaaggttagcctcacagattctggagctagatgattgtgatacttaacaattctgcaaactggggcaagctacttaacttcatgtgctccactcttcttttcagtgaagtggggattataacatattatgagctaaactgtgtctctgtaaaattcaaatttttaagtcctaactcttaatacttcagaatgttactttatttggagataagatctttaaagagataattaagttgaaatgaagacattagtaggccagaatccaatatgaaggaagtccttagaagaagaggaaatttgagcatgggcagggatggagaggagactatgtgaagacataggaaaaagatggccatttacaagtcaagggaagaagccttaaaagaaaccaaccctggtgacactttgatctcagactttaattttccagaattgtgagaaaaaaaaattatgttgtttaagctacccagtctgtggaacaggtataccacattttattgcaattcaatttattgctttatgtggatattacattgtttacgaattgaaggtttgtggcagccccaattgcagaagtctgtcagtgacatttttccaacagcatgtgttcgtgtcatgtctctctcacagtctgataattctcacaatatttcaaactttttcaatattactaaatctcttattatgatctgtgatcagtgatttttgatgtcactcttgtaattgttttgggttgccacaaaccacatccatataagatggtgaagttttgtgtatgttctgactgctccacctgccagccatcctccttccctcacgcccccatcaccaacagtcctcctccctctcttcaggcctccctattctctgacacatagcaatattgaaattaggtcaattaataaccctacaatggcctataaatgttcaattgaaaggaagagtcactttaaatcaagaggtaggaataattacctagaggtaggaataatattagataaatattagaggtaagaataataatgaggaaagcatgtccaaagccaacatagctaggccttttatgtgaaatacagtcaaggtgtaaatgcaacagaaaaattcttgaaggaaattaaaagtgctactccagtgaacacataaatgataagaaagtgaaacagccttattgccgatatgaagaaagttttagtggtttggatagaagatcaaaccagctacaaacttcccttaagctaaagcctaatccagagcaaggccccagctctcttcaattttatgagtcctgagagcagtgaggaagttgaagaaggaaagtttgaatctggcagttgttcaagagttttaagaaaagagcccatcttcataaaataaaagtgccaggtgaagcaataagttctgatggaaaagctgcagaaaattaaccagaagatcttgttaagataagagatgaaagccattacactaaacaaacaaatttcaaggtagacaaattgccttctattggaagatgccatctaggactttcttagctagaaagaactcaatgcctggctttaaagcttcaaaggatgggctaactctcttgttaggagctaatgcagctggttagtttaagttgaagccagtgcttattcagttgaagccattccaaaagtccaaaggccatcaaaaacactaaatctaccctgcctgtgctctgtaaatagaacaatgtttaggtgacagcacatctgtttataccatgatttactgaatatttcaagtccactgttgagacccactccttcaaaaaaaaaaaaagatttcattcaaaatattactgcacattgacaaggtcacccaagagctctgatggagatacacaaggagatgaatattgctttcattcctgcctacacaacatccattcagcagcccatggattaaggagtaattttgactttcaattgttattatttaagaaatacatgctataagggtatagccgacatacagtgattcctctgatgaatttgagcaaaatgaatagaaaaccttttggaagggattaactatttagatacaattaagaacattaattttcatgggaggtggccaaaatatcaacatgcatagagtgtggaagaaggtgaatccaaaccacatggatgactttgagggggttcaagacttcagtggagaaagttactgcagatgtgggggaaattgcaccagaactggagtacaagtagaccctgaagatggaaacaaattattcaatcccataataaaatttgaacgaatgaggggttgcatcttatggatgagcaaagaaaatagtttcttgagatgaaacttatttctggtgaagatgctgtcaacactgttgaactgacaacaaagtacttagaatattctataaacttatctaataaagtaccagtagggtttgagaggattgactccatatttgcaagaagttctactgtgggcaaaatgctatcaaacagcatcacatgctacatgaatatattttttgaaaggaagagtcaatcaatgtagcaaactctatttttttcttgttttaagaaattgttgcatccactccaaacttcagcagccatcaccctgatcagtcagcaaccatcaacctgctagacctaccagaggtctgacctaccagaaaaaagatcacaacttgctgaaggttcagaatattcttagcatttttcagcataaagtatttttaacataaggtatgtacattttattcttaggcataatgttactgcaccataaatatactacaatatagtgtaaatataactttttatatgcactgtgaaatcaaaatattaatgtgactaactttattagaatgtttgttttattgtggtggtccgaagccaaaccttccatatcttagagttatgcttgcactgtattatggaagccctaagaaaccaataggtaatagtacttactacaagggattgtttttagcattaactgaattaatgtatgtaaaatcaattagagtaacgtgtagcatagagtaagtatagatgttattattattgttattaaaattataaatactttgttttgggatttttcttccataggggttctttaaacttttatattctcctacatcttttgcccctttaagattagctcaatggctacatctgtgaaaacttttaagagttgacatattcctcctttgattatcacatttgtcatattgcattgcagttatttgatcatgtgtaattttttgcctatatgggaaattcgccgaaagcaatgatattgccttattggtcattatatgtcctgtgtccattacagtgcctgccagttaaaaacaatatgaattcaaccaggagactgaattcatattagtatatttataaagtctcataaatcatatataaaatacataggaattgtatatttttccctagagagtccaaaattttttcaaattgttcaagattaaattatttaagattaaattttttaaattattcaaattatttaaacattttatgaatcactaatttagtgtttagatatcagaacttggagaagaaaggatctaagaaatgttgatgactttgggttgaatcttggtagattgtaccattcattaacccccatcagttaggacagtgcctggcatgtaataagcattgcaccgagtgctggaagtagaaagccaaatgaggaaaggtgcttgtcttacaaagagctaaaatctggtcaataattcagcacagtacagtgtgaatgccagcagagaagggcccttcatgccttgggaaaaaagagaaagaggagttagtatccacttggatgagggttgagtggtgtcggtcaaggtgcccctttggtgacacttgaacttaagttttaaaaaatgaatagcagagatctaggcaaagtaataagagggaaaaaaagcattctagtaggagtaaagcacaagcatgaaggaaaagaattacgcttctgggaccctgcaagtagatcagatggattgaaaggaaggatattatgtggatatctgtaggtatatgtggtttaacacagacactgtagggtttgcatgaaaggtaattagtcaatattagtttaaaagctgtgaggagccattggaggattttaagccatgcagtgacataatcgtgcctagttacggtataattcaatggaccaacagctgagtttgggagctcaaagggagcaacacggtagtagatagacagcctacttttactgagaccactgggaaaaacttggagcatctacctgggtttgaaataatagcatcccaggagctctatttcctcctgattcctggctaatgttgaaacacatttgaggagtatctggaaattttcactgaaaaacagcccctttaagagaactccacactttaagagtagagattgtcaggaataaatagcttcaaatgaaaatcctgttacatagctaagaaattcaactgtggccgatctcaattaactacaattttaagtatatagtctagaagttcttaacttagttgaaaaaaggggaaacaaacccttggggaatcagtaaggcagttaaaatcagattaaaatacttaaactaatgatgaaacttggagaaacttagtataagaaccaaaaaggcctaaataattaaaagtttaagaaagaaaggcagtttcggtgtttttttctctccttttccaaaaaacatttaatatcattaagtatcaggcaccctgctatgaataattcaatgtgcatccaggattgagagacactgcattaggcagaaattgcactcaaataaaatgagccaggccacactggccacagtagtcaagatgaatctagaaaatgtctcctaacagacctccagacaatgctgggtgtaaatgggaggtctgctattaacttggctttcagtaggaattactgatgggccttcaaagcctcacccctcttacctgtgaagtggtgataacaaaacttaccttactcccttcactgagttgtccatttatttattcaataaatattctatcatgttaagaatcatgacatgtcaagctccagtgatgtagaagcatagtccctatcctcattgatctctctccatgttgtgataaacacatacaaaaagtgttaaggtaatataaatgatgctcttaaagatgtgtataaagcctatgggattacagcagaagcagctaaccagatgggaaacgagaaagtggtatttaaattggatgagtaaattatgggaaaggtatcacatagaatgcgtagactgacagggaccctgggcactgatgtaattgaaaaaataaaagtgatctggtgtgggatgcaatgtagagcagtgcgggatcaacaacaagtgagcccagagaggtggaggtgggtcacactgtgaaaggccttatgcatatcagggtggggagtctgggcttgatcccaagggttaaattgaatctaagtggtttagataagaagtaactgttcctggattttaattttagaactatgattataatggatgtgtgtattatattaaattataataaatcaaaatgtaatacttctgtttagtggagatcatagtatgccaggggagcaatagtgactaagacaacttctacatatgacaaatagctattacttttcttaagatggctatgctgcctctctttcttccaaaatttctcttcatttaacatacattattgttctactattcttcactagagtgatgcttctgaggctcttagaataataaaaaatgactgattgcttcagtaataatttcaatttattggatgacagtcatgcatccagtgctatgctgagaattttgatatatatatatatcatatttatttctccaacaaaactgcaagaaatgtagtatggtagcagtagtgagagttagctcatataccactgtatgccaggtattattcaaagtacttcacatacaggaactcgtttgaacctcagaacaaccctatgagctatgttatacttgtattttacagatgagaaaactggaggacaaaagggatataaaacttgcctaaggttacacagccagtaagtgtgaagtggcagaatcaacatttgaaacctgcagtctaaatatgataagtgttcttagccttaatgaggtatttgtacaaaagtactcccattaaaatacatataaaaataggcaaagaaacaaaaagtgagggtttaggcaactttcctctatttagttagtaaatggagcagtaggaatcaaacctgagtcttttgtacttggcactttccaggacaccaagtgcttccaattgtgtattctgcacacacacacacacacatacactcagtaagcctatatgacttgcccattttctaagttaatcaggaaaaagaaaaacattgaaaaagatctttgagtggaaaactacgtgacattttacattacaaataaaaacttcatctgttcactgctatgtccatagaaaagagaatcgtgcctgtacacagttgataataaatatttgataagtaactatcccagagggttttcagaagtatcccctgggaatgaggagaatatattatgtttcttcaaaacatatattcagaaaatagatactaacaagctattacctacaggcaagtacaggaaatgtatgtagtaaaatgggagatgaaaagcttcagaaagcagagtccttcccttaaggaattttcagggaagaaagccacttaaaccatttatatctatttatctctttttatatctttaatcatttatatgatttttatatcttcagtcaaagaccaagaacgtgtatctgatggagaaaggtgtattcaagtgctataaagtaagagtcattattcaaggtaataacagttaaataagttcaaactgagcatatgtagtacaggcacactttcacatacccaacactcttgtcatagcagacaatactttctggtttccaacatcctcactgaaatattcccagtactatatccctaagccctaagcatcaactttcatgtgacattaatagccttactgctctccccaactgtggtagatttcacttgattctgagaattacagtggaaaagtttatcatatatctactatctgtacagatatagaactcctttattttgaatgacaagtctttcccccagacaaaaggatatcattcctattgtgcataaggcccttcagacacaaactctaacacttgtagcctccccagtaattgacatggtttggtaggaatccagaggaattattctttatgtaataatctacatgataatcttcatgtaattacctacatgataatctgcatatgaacaggcaaggtttgtttccacctctgcttcagaaaatgagaaaaattagtgcttagtttggtgcttatagactaaaacaatagtagaaaagtgggcagcaagaacaaaatagcaaaaatctatgggtatcagcccaaagtatttgaatttattctgtatgtaacatatatgcagtggaagactattgccctttgaagagtggaattgtgtgaaaaaatggtgcatagaaagaattatatggaggtgttacgcagattggattttgttgttgttgttgttgttggagggattagaggcaggggaccaatacatatgatggggctaagtacctatggcccatactaaatgtaagaaaaatcagaggtaatatctgtagataagacaagaaagcaaagaaagtaaaaaatatgtgaacacagagatgccatctaaaagaagcaaaattctctatgaattatctatgaactcaaatgcttctttccaaagaacagcaaatattctatgcatgactaagagtatttatggtttacaattatagaaatatacagaacaccaatacacaaataatttatgcaagaataacactaatatcattggcaatttagataagaaaaagcatgatgtgttaaagtctagcctaatgaacaaagaagataatgtaaaacattcttcagagagcaaattcaactgaagctgacaacctgacatcttaatcacaacaaatgatctggactgctggaaaaaggagcccaagaaaagatcgatcaaatgctaaaaaacagactattttctttgcgttttgccccaaaatagtagttagatatcctcccatgtacttaccatttatttccttctccagccaaaatttttatttacataatatttcttagtttttttccttttctactcttctaatcctctattccaattggaaaaattgacaaactaaagtatgtcttaaaaaagctagtgatctgagcatcattcgatctggagttaaaaatattaattgccactttcaagaaaggaaaatggattattttatttttattaaatctccactatggaaagggagataacatggagaaaaggattcctatttcttctgctaacaaacaatttgtggaagagtgagagactagtgaaaccccctctgagaacaaacaaataacagagggtagaacatcaaaggagaaaactcagaaacatctcaagaagactccagaatataaaccaaatggacttgtgatagtgaacattttgaaatttctattaaaatcccaagttgattacttattatctattttctccaagtgattagtagtaaaattcatgaaatgagaaaggcccagttaagaaaaatcaagggtaataggagctatgaagacatatttcactccacagccaagtggcgaaggcagaggaattctgagaggtggagtggttgtgacaactcttatcagcaagctcctctttgggcccgtctgacaaagcttatccttttatcaaaggtcaaaggagtaaactccttgtttgaaggctttcccctacccacttatatatccttggacagtgagaatcattgtttttatctcccatatccctgatttcttatgatttgcttatttacttttaaaagcatcagtgagggtccaatttatcattttttgttgttgtgcccaaaacatttgagaatctgtagttgtttagaagttgttattaggtatactcattgaaaaaatatgagcttctcagaggcctgattacctaatgggcttagactcaaaactgacgtaactgtcaataaagcttaaaagaattaagtatgcactaaatacttagatatcatttactgagaagataaggaaaagtgaacagatttccttgaaggagtgaaagagaaatggcacttaagaaaagcagttttccttacaaaggagagaggagagttcttagatatataaataacatattagacacttcacaaatattagggcttgaaagaacactgctcatccatgtccctgcaaaggacatgatctcgtttgtttgtttgtttttttttttttggctgcatagtattccacggtgtatgtgtaccacattttctttattcagtctatcactgatgaacatttaggttgattccatgtctttgctattgtgaatagtgctacaatgaacatatgcatgcatgtttctttataatagaatgatttatatttctttgggtatatactcagtaatagaattgctgggtcgaatggtatttccatctttaggtcttcaagagattgccacactctcttccacaagggttgaactaatttatacttcaaccaacagtgtacaacaaactcccatgacattagtttacctatgtaatcaacctgcacatgtacccctgaacttaaaaggtaaaaaaaaaagaatactgtcatctaatccaaggtttgataaataagtcatctggagtccgtgaaatatttgagaacttgccacccaaatggactttggagactttaccccaatcacaattagagcagttctatttgtatctgttttacatattgaaattacattcagtgtaggaatttttttttaaaaagggtttctgcatttccacctctggattggcagtgggagaagcttcacggatcttctcctttgcaaaacaagtgtaactagtaacaattatgaaaaaataatactcccccacttaaagtctctagaagttattctaagggtacacagcaaatgctgaaacatttattcaagaaaatctactacaacattaagagcagtgaggctctgtggcatttgaatcatgatcttttaacttcctctcacttgacagagattgtgttgaatttatagactaacttagaaagtattgtcatgttaatgatagttaagtcttccaatctgtgaacaagggggggtcttcctgttattttattcagatctttattaatttctttcaatagtgttttatagttttcagtatataagtcttgccctgatttggttaaaattattcctaagtattctattctttctgatattactgaaattgttttcttaatttccttttcagtttgtttattgctaatgtttagaaatacaactgatttttatatattgattttgtatcttgcaatttttctaaactcattcaaactgtttatttgtagcttctttatgatttaagacactattatctgcagaaatagttttaatttttcctttccagtgtggacaatttttattctttttcatgcctaatggccctggcttaaaccttcgatacaatgtgaaacagaagtagtctaagcaaacatctttgccttgttctttacattaggaaaattatttgagttttttttttcagtttttaataagtgagtatgatgtgttagctgtggctttttcataggtgttatttatcaaaatgagaaagctctttttttattcctagcttgatgcatgtttgttttttaaatcatgaaaggtactatctttttctgcacctattgagatgaccatgggattttattttctctttattatattaatgtggtataataaatttattgattttaatatgttgagccacctttgtattcctcaaataaatccaatttggctttgacataaacatttttatatgctgctgggcagtttttcagtattttgcttagaattttttttccatttgtatttgcaagtgttattgttctgtagttttctcttgtgatagttttgtctgactttgctcacaggataatactggccccatagagtaagtcaggaaatgttccctcctactctactttttttgaaagactttaattgatgttctttaaacatgtgagaaaatcaattaattaagctatcttgtcctgagattttctttgttgttgttgttgttgtttttttttttttttttttttttttggatgagtagcttgtatctttacttactacaggtctgtttagatttctatttcttcttgagtctgttttggtaatttgtgtgcttctaggaatttattttatctactttatctagtatcagttgctgccatacaattgtttatagtattcctttgtaattttttctcctgtaaagacaatagtaatgtcccctctttcattcctgattttagtaatttgaatcttctttttttttttttcttggccagtctagctaaatgtttgtcatttttgttgatcttttcaaagaatcaactttttgtttcattgattttctctactgtgttcgtattctctattttgcttatttctactcgagtctttactatttctttcttcttatttgagtttagtttgattttttattttcttgtttctaaggctggtggttatgttattaatttgtgatatttccttttttaatgtagtcattaataaccataaatttcaggccaggcacagtggctcatgcctgtaatcccagcactttgggaggccaaggctggcagatcacctgaggtcaggagttcaagaccagcctgaccaacatggtgaaaccctgtctctactaaaaatacaaaaattagctgggcctagtggcaggtgcctgtaatcctagctactcaggaggccgaggcaggagaatcacttgaacccaggaggcagaggttgcaataagctgagatggtgccgttgcactccagcctggacaacaagagtgagactccatctcaaaaaaaaataaaaaatctctgtcattgccacttttgctattctccatggctttggtatattttgtttttaatttatctcaaagcattttctaaatctcttgtgattctttctttaattcaactattatttagcagtatgttgcttaatttccccatatattcataaatgtttcaaattcctttttattattagtttctattttttttccattgtggttggagaatataccttgtatgatttcaatcttttcaaagttttgagacttgttttatggtctcacatgtaattaatcctggaaaatactccatgtgcacttgaaaaaaatgtgcattctgttgttgggtagagtgttctataaatatctgttaggtctcattggcatatagtattgcgcaagttttttcttgctgatttttggtctagtcctatcccttactgaaagtggggtattaaaaagtctctattatagttgacttgcaaatgtttcccttcagtttgtcagtttttgcttcatgtattgtgtggctttgttgataagtgcatacatatttataattcttgtatcttcttcagcaattgacctttttattgttatattatgtcttcttttgtcacttgttaaaatttttgtcttaaagtctgttttgtctggtattagtatacctattcaagctctcttttgaatattttttacataaaatatctttttcttttcaacctatctgtgcatctaatgtgagtctcttgtagacaacatatattgaggtcattttaaaaaatccagttagccaatttgtgtccttttattgcagaacttaatctacttatatgtcatgtaatggctgataaaatgtcattattcttgacatttttctatttgttttctatacatgttatgtctttctttattgttcctcagttcttccattactgccttcttttgtgttgaatacataattcctagctgttcccaacctttttggtgccaggggctggtttcatagaagataatattttcatggatggaggttgaagggatggttttgggatgaaactgttccatctcagatcatcaggcgttagattctcataaggaatgtgcaacctagatccctcacatgcccagttcacctgccgcttagctgacaggaggcagagctcaggttatactcacttcaccactcacctcctgctgtgtggcctggttcttaacaggccacagacaagtagcagcccatggcccaggggttggggacccctgttatatggagcatgctctcatttttatgctgttattgtcccacattttatctgtatacattatatgcccaccaacctggatttatagccttatatattttcttttaaataggatagaaaaaataagttacaaactcaaagagcatttttgtagtcttttaaatttatctatgcagttatctttcacagtgctctttactttttctggtggatgagtcactgtttagtgtcctttcttttcagcttgaactgcttcctttagcatggttggaggaagtctaccagcaatgcaatctctcagtttttcatttattgggaaatttctttatttctctttcatatttgaagaataacattgccagatatagaaatctggggtcacaatattttctttcagcactttgaatatgccaatcctttgttttctggccttcatagtttctggtaagaagtcagttctctcttctctccttctagcacttctgttacacatatgttgatatacttaatgatgttgctcagatctcttaggttttgttcatttttaatttttttttttttttgcattttattcttcaaagtggctactctcaatggaagtagaagttcagggacttgtctaaggtaataaaactgtctgatagtagatgagaaactactgcacacgtccttgccttaacccagttatttgctcattccattgaattaaaagaagataaactaaaaatatacaatctctttttaaccaccaaagaatatctacaagtgaataacttttgttatcagagaaaacatagcccctgggaaataacatgtccaaagttacatgaatagtaaatggcagggccaggaattaaaacaatgttcttaagaaccaatctggttcttaagcccatcaactcctaactaaaaagaataatataattaaataagagggaatcattattaatcaaaattaagatagattcagtataacaacagtggtatgtatttttaagaagttacatatggttctgtcattatgcattgatgattgtccagcagatatgctgggaagttggtagaatgccagcttggaaggaaagatgtggggtcacaagtaagctgtgcctagaatattattctggttttaggtagggtaagcctctgaaaggggatccaggggtctaaacatgaacattcgaggaattttatgaactctggtttgactttggcttactattttatttcttggtcctattttttccaacttctgatatatttttttaacctaactacattcgctacttcagagtagtaatatttgatgttatttccaaagggacctaatttagcgtaagatctattgttcagaaacaggtggttgaggttatagctttgggtagtctgcctgcttggcattactttctcagtgatagaagtttaaatagtgtcaaccttcttgagaaaaagactaaaaagaataaggccaaatactaatgttctagccaagtattctacacaacagggtagaatttgattctcagtatgagaaggaaagtgctaagcttgcaaggaagatgtctaggctgtgtaaaaaaagagattaggagagtgctatagtcatcgtgttcttagaattcatttttagcgcatctgtggttacgtaaatgttacgaattctagactcattcattttgggcatgaatgcaatggttctcaacccattataatactgatgcccagacttccatatctgttaattcagaatttctgtgtttggggcttgcacatgggtattaaaaaaagacacccactgattcgtgcagcaaggattgagaaatacttttgcaatagattacctattccggtaggtatgacttagaaaatagatgaaacagacataataacaatgtattgagtaactccagctgagtgagggtggcaaaggcactggctgctccccactctgctctgaaggaatggtgttttatcagagcctcatagttggtctctggtattagatttgaccctgtatagtgggaatagataggtcagcctttggaaggaagaaagccgtattgttgaacctatgcaaaggcttagaaaacaggccagtgcctatttacattgtttacaattaaatgtacaataaaaatactttgtttttcttaaattcacccaatatctgtccacttatcatatctgtttcttcataatttcatgggaattttttctcatatattctatgatgcacattataaaaagtgtcaaagaagatgatcataaatcctcattttttccaatctaacacctaactttaaaatcttttcatacttcacactgagccagaaacagccccaacttatttcactttttttttttttgcacattttcatttggccagatgttgccatataggtaataagagatttcctttatttttcctttgaggaaaagttgttacatccatcaggcttctagcaaaaaaaaaatcaattttcttttttgttcttgcctgatttgatatagatagctaatatggaaacacaatttttctccttcactactttcaaggtatcaggtgtcataattcctcaaattataaatagttaaaagaaacataaaaaaagtttctcatctgtgttcagatagaatccatttgagaagaaaattttccgcctttcaccatagcaatcaatcactccattgtcataatgccacaccttcaacatgaatttaaaggcataaaaataagtgttgtggaatcaattagcacaatcttttgggactttgcaccaaaacacaattgcacattgttaagttttatgaagaacatgatttttttaaaaaaatccatattctcaagatacttttggggtgttgctacatagtagtgcaggaaagactatatgcatgaaattcaaggccttctttgaggaatttttagcatttctgtgttcaataatttaatggaagactacagtaaccaaagaaaggtgaaaatcactcagaattcaaattctctgggaaagaaagtttgagtcatttgataggtagagagcgttggccagctgaaatgctggctgagtgcaaatataacatttaatgggtagtaaaaaaaatacataaataaaatgaggtctgcagcagctacgcatcttttctttcctggtccttctgtgttttcacatataacctaatttgtgtctgtctgtgtgtatacatatacagtatttttatatattaacatttcatgtctcattatttcatatgtgtgatcaacgatatttaatcttataattccctctttagagtacagaatgtttatataaaccatgacaaaatttgaagtttatataacatctcccagagacggataatatggctattaatcagaaaggaataattaatcagaaatggcttttgggacattagttacctcttcatgaagatagaatgaaataatcttcgtttgaaaaaaataccttaagtttgttattgttattgtgtgaaatttacctatgtatgggagggtaaatgtgtatcaatgcctgatagacaagaggtggactgtgccagtttttaagctattgtttccagccccaacgatgtcctactacattccactttgggatactggggctgagaatgtgtaagctgcatttctcttttgctagttgaacccctgatagacactacatataggctagaacagcaaaggacttgttccttcttgtttatttcagtgactgttcttgaccctaggaagagcagtagagtctagcttctagctttcttatcagcacaccaagaatcagcattatcattcctcttaagaagtttcaacatgctttaggccgtattccccattccctcacacccctacatccctctctgctcaaaaatctgagatctagttctgtagagcactagtatactcatgagctatcagtaccagttgactaaagcctcctactcaggagtttgaattactgccctgtgaggctcctccttcaatgtcaggtgatatgagatatcactactaaataaacagtgtcccctcttcagaaatctgagttcaggtttttgaagcccttcccaaaactattagattctaatatctcttactactttgttatttttacccagtcctaggagtggtactgcttcctccaatgcctatctctaggcattttcagttttttttccacttttgaattttcaaatatctatttaagctattatttattattatataaacaactgacattattaaaacaactagcattgtttctgttttttctcattgaatcttgactaatatgaaacatgaacacacacatatacacacacacacacacatatacacaagtacacacacatacctctatcattttgtataaaactatagaaaacaaagttctttatagctagtcgaatgtgggttaatgtgattttttttaatacaaagttaagaaaaacctagtaattatagagtatatattgaaggcatatgacataggacagtatcagaaatacttcgtgtgtatttagaattcatacattttacaggcaataacttacgttcacacatccaagttgctctaaaaatatttgtaagtttttcaataacaaacaaatacccgattttaaattaaagtttaaaattatattcttcagttttattaacaatattttacgtgctcattagccacatgtgcagatataggtcattgtctttattactcatatttcaccctgattctataacaaaccatatgtaaaatttttgaacaatatatggcagtttaatgatgtcaaagatgagaacagaagtaaaatgccactgtttaattaaaatatgtgacttattttgtcagaagatactagaccagcaagtaataataataataaatatcaaaaatttctgaaatgtataatggaaaaacaatagagacaatcaagtaaactaaagctgcctcttaaaaaaagacaaataaaatgaacaaaggtctaattaggctggttataaaaaattagaagagatagaaattaccaccaacaagaataaattagcagcatcactacagaacctacagatatcaaaaggataagaagtagacattatgaattattgtataccactaatttgacaatttaaacaaaatgaactacttctttgaaaaccacaaactactaatgttcattcaagaagaaatagattggttgggtaacattaaatttattaaaccaattgagttttaattttaaatcttttctacaaggaaaatttctaatctagctgactttattggtgaattctgccaaacatttaagaaaggaatattgccaattaaatacaaacccttcctaaaactaaaagaggaaggaacattcattttattttattttatttatttaatttatttttcattagacaggtcatcaagacagaaagtcaatgaaaaaacaatggatttaaactataccctagaacaaatgggcttaagagatacttacagaactttcaacccaacaaccacagaatatacattctattcatcagcacatggacctttctccaagatagatcatatgatgggccacaaaacaaatcttaataaatttaagaaaattgaaattatatcaagtactctctcagaccacagtggaataaaattggaaatcaactccaaaaggaaccttcaaaaccaggcaaatacatacaaattaaataacttgatcctgaatgatcattgtatcaacaatgaaatgaagacggaaatttaaaatattttttgaactgaacaataatagtgacacgacctatcaaaacctctggaattcagcaaaggtgatgctaagaggaaggtttacaacctttaacatcaaaaagtctgaaaaagcacaaatagacaatctaaggtcacacctcaagaaactagagaaacaagaacaaaacaaacccaaacccagcaaaagaaataaccaatatcacagcaggactaaatgaaattgaaacaaaagaaatacaaaagataaatgaaacaaaaagcttgttctttgaaaagataaataaaattgatagagcattagcaaggttaaccaagaaaagaagatagaaaatccaaataagctcaattggaaatgaaatgggagatattacaactgatgctacagaaatacaaaagatcattcaaggctactatgagcatctttatgcacataaattagaaaacctagagtagatggataaattcctggaaatacacaaccctcctagactaaatcaggaagaattagaaagcctgaacagaccaataaaaagcagcgacattgaaatggtaaggaaattaccaacaacaacaaaaaaggtcctggaccagacacagtcacagctgaattctatccgatgttcaaagaattgttatgaatcctactgacactattccacaagataaagagtgaattctccctaaatcattctatgaagacagtatcacccgaacaccaaaaccggaaaagaacataacaataacaacaaaaaactacagaccaatatccctggtgaacatagatacaaaaatgcttaacaaaatactagctaactgaatcaaacagcatatcaaaaagataatccaccgtgatcaagtgggtttcataccagggatgcagggatagtttaatgtaaacaagtcagtaaatgtgatataccacataaacacaagtaaaagcaaaaatcacatgatcatctcaatagatgcagaaaatgtacttgacaaaatccagcatccctttatgattaaaaccttcatcaaaattggcatacaagagacatacctcaatgtaataaaagcctatctatgacaagcccacagtcaatataatactgaaagagaaaagaaaaaagcattccctctgagaactggaacaagacaaagatgcccactctcgcccttccattcaacataatactggaagtcctagccagagcaatcagacaagagaaataaataaagggcatacaaattggtaaagaggaagtcaaactgttgctgtttgctgataatatgatcatatacctagaaaaacctgaagactcttccaaaaagctcctagaattgataaatgaattcagcaaagtttcgttatacaaaattaatgtacacaaatcagtagctctgctatacaccaacagcaaccaagctgagaatcaaatcaagaattcagccccttttaaaatagctgcaaaaataaaataaaataaattacttagaaatatacctaaccaacgaggtgaaagacctctagaaggaaaactgcaaaacactgatgaaagaaatcatagacaacacaaacaaatggaaacacattccatgctcgtggatgggtagactcaatattgaaacgttcatttaaaatggtcagcattacctagataccaatacttggcagggctgtgtgttacctggaaacgaagtattatgtaagagcagaactcaacaatactaaataaatacctcaataaaaacagatatttgaaaaacaactcttcaagcagttaacatttgtagttggcaaattcttgtcacctgtatgcaatgcttataggctaagaagtctacttttgcaataggtactgacttaactataaaggaagaaagtgaaaggatctttcattgacaagtacagaaagagagcataagaattaagagaaattctaatccagctgaaataagttagaattctgaagtttaaatttggaggtatgactaatttgcttgctatgtgaaagaagaaataaagtcatgtaatatagagaaattaacctggatttgggatcagattgtgattcaatttaccacttaaccactttgtacttcagaagcactttttcaaaatactctatttatttattttaaaaacaaatgactgtatgagactgtttctataattaaatgacataacaaaggagtatttcctgaatgttgctttccttttcatgttgaagcatgaaactccttaaaatgatcctcaaggagcctcattacgtccccgatcttattctcctgtacagtctccctagtttacaatggtccagttattctaatcaatctgttccttgaaattcttagtttgttttaatttcagaggttttgcacttgctttttctgaatcagtactttgtttaatttcaaaacacaaaacttatgtggagtgcaagcaccaggtttctaatttttcagggaattattttactatccaggtcttgaaggctaaaatcttcctttgacttgtagtggattttgtttttctactatactcattcatgaatgatacagatttctagggtctttgatttatgtggacattttgatcctagccttgggtgggctcaagtctttcatttctgccccattatggactttaaaatcttatgccctaggttattgagaccaaaaccccaacagccaaggtaaggtacaggccagcttcctagatcagtactcctgttttaatttattttttctttctgaatcttattagccttactgttctgagagatagatatgcatgtaaaataaattttcctattatatttttctggcttggtactgatcgtctcaagggaattttcagattctcatagtctaatatctcactagaacagaaagccatatatcaactttaagaattgcacataaaatatcttaaaaataaatcaaatatcttccttactcatagaacatgaaaaaatagaaggacattggaaatcagaaaagccaatgtcctcattttgtagtgaggataaaaggaaatatatggggatggcataactgaaggcgacgcaacttaagagtgacactactacagtaagggcttttctcaaggcctgcttccctcacctccatacctcaacactgagtactagaggtaattacatttcaatgatttaactgatatgagcaactgtctgattagcatcaaggcacctcacagaacagggatcattggtgttaagggatttcaaaaatgttatttccgttctccaaagcaattgattcctggtttggtaaaagaataccccatcatgtgaatcttgaagctttttctcctgactttttttacctgacgtacaggagctgtgctgcttctttttctcttgggaaagcactttttctaaaaaaacagaaacaaaacttttttcctttcaataaatatgctttgtataaggacacagctacagaaaactttcagctgccatttcctctttgactttttgaatttagtaatatttctttcctgagtattcaacagattcttatccttattgttattctagattgttgtgacattttgtacttaacaagatatatcttgggcatgctttactttaggataaaaataacatttgtattgtccatgcatgttattatttgttttctgctgtggcaatccgacaagcagaaatttgttttgatacttcaggaaacccttatgtcatcaaaattacattaataaacagtcatatgataaacagatatgttatgaataatctggtaaaggagcttttcaaaatagcatttcttatagatattttatacattagttattgttctttaattcatttttcctttgaggaaaatctgagataatttccctacagaatatcttttggaattaaacccatatgttttatagtacctgtttaaacatttcaacatgctttaatgttttttctctcatttcttcagcaaatttcacttaaactatagattcagtcacctgtatcttaaaataaaaaaaattctaaaatactattttcttaattcttgctcccttcaaatgatttgttttcttatttctctattttatcatcacaattttaaaagctaggtctgatttaacattttcaacgtcaagtctgtcattattccactactgtttgactttcattctcactacttgtaacaggctgaattgcttccctgcaacatttgtatgttgaagtcctaatcccaagtacctcagaatgtgagtgtattttaagataaagtttttaaagaccttattagggtgaaccctaatgcaatatgactggtatctttatatgaagagaagtttaggacacagacacacagacagggaagaccctatgaagacatagcaagaagatggccatctacaagtcaaagagagaggccttagaagaaattaaccctgcagacaccttgatcttggatttctagtccccagaattgtgagaaaataaatttatgttttttaagccacctagtctgtggtattttgttatggtagccctagaaaactaatataccaccctataaataatgtttttgatatgattatcagttacttcctaattgatataatgacagaatcaaaacacagggaatttaaagtaagacagaagtgagtcaaagtcctaattttagtcaattaatagtgctaaaactttgggcgaattatttaatctttctttgcctccgccttcagactttaaaaaaggaaataattaatattcatttttaaggattaaagaggatggttacatggaaatgccttgtgtaatatcaagcagataataatgaaactcatgacactatagttctttcctgttgtccagaccaacatgcttcctaaattcagaccactgatatatttaatgacataaataatggatgatttgtctaatattgttttctctaacttacacaaactcttcctttctaattcttattctcctagtcagcccccagccccttaagaactgatgacctcccttcacacttgaatcagaaaatagaaataactagatcagtacaccctaatttgtccaagaacaatacatgcatctatactctatcttgtgtctccattcaggcatgaaggaagcttccttccaactcatggcaaaggctcctctctccattgggctttagatttcacatctccagtaccttgctgtggcaattttttcctttttctcctatgtctctttctctgaatgttttcattttcaacaacatataatcattctctaatacatatcctctctcttaaaaaggaaatctcaaatcctcctttcttgttcatatcctctttcctgcttcccacttaaaaatgctccttattttgtgaaaacttttcaaaagttttgtttagaatctgctccagtctggctcccgaagcttccattctactgaaacttttctgttgccaagggcatgatcatccttgtgttttcagacccaacaggtacttttctctcctcattttatggatctcttaagagtacctgatttatttttccactgttttttttttttttttttttggctacatggcttttgtggcttaatgtcctttttttcctgcttcctcactggtcaatgaccctctgtcttctttgcttttgctgactcatctgtatcggctcatccttttaatgatggggtatgccagactgcttccttttcttctgtgtttatactcaatttctgtgacctcattcactccattgattttaaataatgctaaataattaagttttaaaacttaaatgattaaataacacgaagtgattaatgctaaatagataaggctaaaactaccaaatacatgtatctaacctggttctctcttttgagcttgatactccaagattcaactgactacttggcagcctctttcgggtatctatttgccctatcctaaaaagacccaaagatgttcaaagagaactttagttcattttctttgctaaatttattacttacccatcctttctacttcagtaaacatctccactcttctctctaatgcttctaattattggagtaatctttgattactcttttttctttatttttaaaattactaactacatctatattatcacatagtccattaacaagccctgttggttttacctctgaaatacataaggttcggttttctgtttcccaatagctccattgtcacctctgtggttgaaatcaccatcatttctcatttagaccaatgcaatagagtaatccatgtcacttttgaagttttcactctaacagtctatttgtcacaatagccaagacaacttttaaaaatgtcaatctaaaaattatttcagcacctggattaaaataatttaaactctttcctctatactgtacttagggctctattgatctctgctgatctcttcaatctcatattgcaccaagttcctcttgtttaccgtatttagcttttctagtctcctttccaaacctgaagcaagacaagctcttttatgccatgggacctttaaatgtgtgccttctgcttcctaaaaatcttgtcccagagggatttctatggctacctcttctccgtggtctcagtgtcaaattacaggtcatttcctcagagaagccagctataggtagcctatctcaactggaaccttctcccaagtaattctttataaaatatatagatattatatcacatcatagtgcttaactgaattttgtgcttatttatttcttttctggtttgcttatgtttctcctcactagaatgcaaatattttaatagcaagttccttgtctatctagtaattgtgtgctaagaacattgttacatatatattttcacaatatcatactaaaaatcaaagctgtaactttagatggctacaaatattagcaccattttatggctgagaaaaagaaggcttagggaagaataagcagcttgccagagattatgtagctagatgtagcaggtttgggattcaaaatgaggcatgtctgatgctaaaatctatgatcttaatcacatgatttactgcctcttagtctcctgatttctgggcttttgatttactttagagctctgttcatcccttggctctgatatttggtgctatttcagtgggtctgacatttggctctcgaaataattatggtaaagatctatcctacagtcatgctgcttctgtctgcctaaatatcctcctgctatgttgagtatattccacattgcccccaggatctcctaatctgcagggcaagaggttgacactcttccctccgctttgcagaaaactgtgtgcctttgggcacatcatcttctctgggccccaatttccttttttgtaaaataaacaatttgaattatgatcttgaaattctctttaagatttcagcaataatgacaagtcatgtttctttttccccctgcctttaagctttttaagttatcaatattttaatttaagcaatttaactttcctagtactagaatatattaatcctacaaagagcagctacattgttgtaggaacattctttaggttgttagttatagtacatgatgtcttcatcacttgatagaaagcaattcaactctcttagattaatatttcactccacaacaaaatgctactgataacccagtcgatgcctgcctgcctcagagttatcaattatacaacaacttagtctaataagtatgtaatgaatgtctcctatgtgctaggttctgtgctaggtgctaaaaatgatcgatacatagatgctgtctgccacgaacccatgatttagtgggagagatggacaaaccatgaatcagtctaacaagcacagagtggtataagagctaaatctaacaataacatcaaaaagaaaaacagctgtcagaatatagacaaatatgactataatggtataaccgctctttgttctagggcattaattctgctttagagaacaaatcagggagcagtttttaaagctggtcacaatccaacagtgtgaaaagaaacccagaaacagataggtcctcctctgccatcccatctgattgctagaatagactttaagacatttttctggtttccaagcttacctacccccataaccctgagatttctgcctttctgagcaagcttcagccttgcagtcaccagcagggaagcaatctgctgttcattcctgaagccccagggacctttcttactgccgcccttctggttggactgtttctgggctgccaagttggcaaggcgtctggtttgaaggcatgtgggttaggacagtcttcttagcaggatggccaaggggaggcttggggagtagagtagaagggaagcctcactggaaaatacagccaaaatgtcactccagaagatgtaattaatctgtagctaaggagggaggcaggctggccattcctggaatgtattgtttcaggtttgcacctaaactagattcctacacatttaagagacacgctaagggagaatcagtgaggtgatgccaatactggagagcatttagagtacagtgagtaaagaacaaaagcattgaatatttttttaagccccttatactttagctctttacaggagctagtctttgttaatgtgttatagtttataaagtatgaactcaggttcttatgaggaaagtagtattattactgcctttttgtaagtgaggaaaattaggcttggagatctgcaactttcctaagatcacacaaaagaagcatgaagcagacccaggacataatcacggaacttctgactccaggtttcatgatccttccactacaggattcctcttcacagttagaatttagtatctagactgtgagttttagtggtggatgtcatgtcctgccttttatacctcggtctcagttcctaagctagtgcctgtccagtcaggttgactcctatgagccccagccacatcggagtatttaagaatcagttaaaactgctggcccaagcttctgagcatgctaaatggcacatctccccacccttaaattttggcccactgtttgttcctcttcagattctgttttgttttttttgtttgtttgttttttttttttgagatggagtcttgctctgtcgcccgggctggagtgcagtagcgtgatcttggctcattgcaagctccgcctccaggttcactccattctcctgcctcagcctcccaagtagctgggactacaggtgcccaccaccaagcccagctaattttttgtatttttagtagagaccgagtttcaccatgttagccaggatggtcttgatctcctgacctcataatccgcccgccttggcctcccaaagtgctgggattacaggcgtgagccaccacgcccagcctgttcctccagattcttcttaatcctcatttccctgtctgcctgccccaactgagcatgctaaattttttatcaacttgctttgcttggaatgcctcctgcagcagtaactgcactgcttgactagtgttcaaaataatcccttatcctgatagttcctgctcccttgttggaggaagagtatactttctttgtctatatccaatatacactttccttctattaagcctccatctaaaccctttatgaaacagtatttagtactggttacttaacctctcggaatttcagtctattcttctgtaactattgattgaatgagtcaattcatgtgatgcgcttagaatttggtgtgtagtaagcacacaataaaccttagttttgtttttagtatttttgtaatgttgtaactattgacttttctgaagtttctttcaaccacatatttctacacctttttgttttgttctctatatattgactgtttttacacacaaatgtcacaagtaaaaaatctactcattcttcacagaaccaccagtcataaaattgtattccaaacaatagtatcaaacggctattcattgactatcttatgctaggcatagtgataggtgctgcagattcaggggttaaagaggactactcctgtggtccccgttctttggtgctctttttctcacttccaaatatcctgtcctattgagccactattactgcagagttacgttttgctttacattacttagttgttgacatatctgccctcgaggaaactagttggagaataatagtatttagtaatcacttcatccccatggtctaatataacacatgacacataaagggtacttaatgttagttgaattaacagatgaaggaatgcatatgtgcagaggtgtgcttgttttttttctgtataagccattcttgaatgggaatgtgcaaagaaggaaatatttctaaagccctttttttgctgttctgacatttatcgaaggtgcaccatctagcaccaaccttttactttcctcttgggaaggctatgcacataaaagcttccaatctactgctaaaacatggacaatgtgtagcataagacaaaataggtcacacaaaagtgagacatggatttgcaagagttaattccatgcagagaattaccaaaaggagaatttgaagacttgcagaaataaggaggagccattgaatacatggttctcgccataagcaggccgtgctaagctgagagggcatttcagaagctggagctggacagagagaaatacagagtatgtcaggaaaaatgcagaacctggagctcaactgcctagtagatctctttattgaatcaatctatgagagagataattctgtaaaatatgagtcaccagtaattactttaataaaaatagataaaaggaaacaaacacaagtttaagcaactttaagagtataggcaaatgataaaatatccctctctacccttttgtatgtttgtttgcttatttatctgtgcagttttggaaatagcctctatttttgatattattgcaaaaatgtacatatctgttgcaaaaaagttttaaaatttgtaaaacacaaaggaaataaaatttatgcataattctaccaaccaggggtccattaccaacatttttatacccttctcacctctattaatagatatatttgcgtttgaatatacatgcatatgcttttgaaatggaatatttttaaatatcctattctataaccttccttatttaataataaataataaatattttaaaacccaacaattataaatacacataattttaatggttactgaattttccattgtatgcaagagttcactaaatgtatttatagaatgctttgagaaatgacagcagagagtatatttcaactacatttcttagccagtttgctagttaacacactgcagttggacattgttacactttattaattcgattaaacattgtgtgctgggaattaccctgagcacagaaaactacagatacaaagatgtgatagataaaatgagaattgaaattataattcaagatcttgctaggtaaactggacaattataatataattcataataatacaattctaatacaatgtcttaagcttgacataaaaggttagcccccaaattcttggagactcaaaagactggagtaaggaccttggggaagtggagaaagctgcactgacaaggtgatgcttgaactacctcttgacttataagtataggtggaatccccatttgcatgtacattaacatgcctgtttaggaagaatgcagaagctgaagtgtccagtgagtggcccacacatgctaaataagtatttattgaatgaatgtagaatgaatagataaaacaataaaacggaatcttctaaaacattaatactaccctgtaacatttatatcaactgattgggacctctaaaccccaataaagcactgtattcctttgccatgcccgctctggaataatgcaaaacctataaacttttgagaataacaaatttttgaagaatagttattcaaattgttggagaatgataattattgtagcatcttattattcagtatcacctgagtgttatttaaaatacttccaacaccctgacaaaggtggaattatgtgatatccattatatagagcagaggctccgtgattgagtggttaactgactcatatctcagtcgaggtctctctgactctttaattcattaccacactatgctccctactctttatagagagcattttagatgcataccttctttgatttctataacttctgagttggtcaggacctctttagggattcccattttagtgatgaagaaaataagtctcaaaaaagctacattatttatctgaactcccagggatactaattaacagattctaaatgtaaaaaaagttttcttccattggcccacactgccattaaccactcctgacacaatgttctacatggaaaaatttctgaaatgctagttgtcagaatagagctctctagtttatctccaagatccaaatgaccaccttcaccaaagtccttccacactagcaggtctatgtgctataaagtcaataaagaggccgggcacagtggctcatgcctgtaatcccagcactttggaaggccgagatgggtgatcacctgaggtcaggagtttgagaccagcctagccaaatggtgaaaccctgcctctactaaaaaaaaatgcccaaattagctgggcgtggtggtgggtgcctgtaatcccagctgctcaggaggctggggaagaagaatcacttgaacccgggaggtggagtttgcagtgagctgagattgcaccactgcactccagcctggacaacagagaaagaccccatctcaaaaaacataacaaacaaacaaagataacccaaaaaacaaagttaataaagagccaaagaagccccttctgaaattttatcctggacactcatctttctctgaaataataacatatctttatcttcttcagaagtgtatccaacctgactctttccatgctcttcactatgccaaaatatttatgatataatctatggttggaaacagtataatgtgatttaaattgctcaaaaaatctgggttcaaaacgtggtatcatcttttagtatccatttaaagaaaagtaaattattttttctttatcttcagtcttctcatctataaaaatggactgcaatacgttacataattgtagtgagacaatttcactattatattaatatgaaatatatatatgtatagtatatactatattatatagtatataaaatgtactatataatatctattatagtaatatataatataaaatatattaatatattaaattatattaacatctatacaaatggactgcaatactttatataattgtagtgatacaattttagttaattgtaagaattaactgaaataatattgataataacttaagcttttgaggtttttgttaactgctataacctattgcctagtatagtgtcaggagctcaataagtattttctaaatgaattaatgagtgaacagattcattgaattaataaatatgaatgaatgattgaatataatatttaaagggcttaaatatttatcagacacatatcgtatttcttgacattttgttaggtcctagcaataaaactatgaacaaactagatatgatcaatgcagaactaatggtgaacactgttaagaaaacaggcaagtaagcagagtacagcatgaggaggatccacagggtagacaagagtacatacgagggtaaatttaagtgtatgaggcagacatttcttcctgaggcaggtcacatctgtagaagtaacatatgaaaaatttctgtcacaagacctggaacttagtatgttcttaaatagttcttcatgctttctacaccctctcccaccatccaagttgaagagcatttacagacaccatcagctttgcttgatggctgttgtagtgttaggctgatttaatgacccagatacccttgtctttagtttttcccaaatctgatgtttgtgtagaaacagaataaacaactcttcaaccaattctttcttttggagtcttcaaccttctcaaacttttcaaccccatatccacgccagaaagttttttgtttgtttgtttttacaaacctgagaacagcttagagtcccttgtcaaaccttaaactgaatagaggagaaaaataattttaactataaattgaacttctctatttgtaacttacctattaatcataactaaaagcatgattaagctgtaactaaaaatcccaataaagacctgcaactgtactaatgtattactgtcatttcttcaaaaagagattatccagttgcaaagtccagaaagaaaattagagatttagagcaattcactctttttacagatagtactactgtataagaaacaaatgttcatgaccttaaagccatgaacaaatgactgaattaaaaagaaaccatatgaaaaggaataacttctgaatagcaaaaaagtaccattaaaacattaaaagataataaccaaaaaatatttataatgtttatgacaaaaagaactaatttttaaaaattgtgaacaacctatacaatgcaataataaaaccaaaatgtaatataaaatagcaaaggaagtaaatagaaatttcacaaaaaggaaatatcattaattttgttattttgtttctttctccactttttgtattttctgaatattttttaggtgataggataggttttagatagtttttaccaattggatcctttatgttttatttttatttttattttttgatttccagctttcattttaagttcagggtacatgtgcaggatgtacatgtttgttatgtaggtaaacgtttgccagggtggtttgcttcacagatcaacccatcaaccaggtattaagcccagcacccattagctattcatcctgatgctctccctccaccccaccctactcaatagagaaacatagggcttacaccacattttagatcaaatggacccgacagatgtatacagaacattctaacagcaacagaaaatgtgcattattgtcacacacatggtttatcataaggatagatcatatggttagacacaaaacaagtcttaacaaatttaagaagactgaaataatcaagtatcttttctgaccaaaatggtatgcaactagaaatcaacaatagaaagaatttcaaaaaattcacaaatacatagaaacttaaaaatatgtttctgaacaacaaatgggtcaatgaaaacattaaaaaggaaatttaaaacctttagagaagagaaaatggaaacacaaactactaaaacttatgggatgcagcaaaagcatttttaagaaggatatttataacaataaatgcctacattaacaaaaaatatttcaaatacataatccaatgctgtacttcaaaaaactgaaaataaaggtcaaactatgcctaaagttaacagaaggaaggaaataataaacatcagagaagaagtaaatgaaaatagcacaaaagataaatgaagctaagagttggtttttaacaaggtaaacaaaattgacatacctttatccagaataagaaaaaaaagaagatgcaaataaataaaattagaaatgaaagaggagacattacaacagataccatagaaatataaaaatcataagagactactaagaacaacgaattgggtaaactagaagaaaatagataaattccaagaaacacacaatgtccaaaactgaatcatgaaaaaatagaaaatcttaatagaccaataatgagtacagagagtgaattagtaataaaaattattccatcagagaaaagcttaggacttgatggcttcagagataagttctaccaacatttaaagaactaatacaaatccatcaaaaactcttccaaaatatttaagtggcgagaatactttcaaactcatttcagaaggccagctttaccttgataccaaagccagactaggagagtatgacaaaacaaaattacaggccaatattcctaatgaacatagatgcaaaactcttcaaagaatactaaaacactgaatttgacagtgaattcaacagaaggctggttcactatcatcaagagggattatcccaaagatgcaaggatagttaatatacaaatttcacagttatatttgtgaaaaatcacatgatcatatgatcattttaatagctgtattaatagaaaaaagtattcaacaagtttaacatccttttgtgataatactctcaaaaaattaggtatagatggaacgtacctcaatacaataaagtttgcatatatgacaaacccaatgctaacatcatacttcatggcaaaaagtagaacttcttttgtctcatatcaggaagaagacaaggatacccactctcaccatgactaatcaacaaatactgtaagtcctagctagagcaattagctaagaaaaagaaatgaaatgtatccaaattagaaaggaagaaattaaatggtccgggtttgcagacatgattgtatatactgaaaaccctaagaaatctgctaaaattctattaaaaatttaaaaatgacttcagtaaggttacaggatacaaaaacaagatacagaaatcagtagcatttccatacactaacaatgaactatccaaaaaaagtgaaggaaacaatcaatttacaatagcatcacaaaaatgtatagatcaaaacatcacattgtacttactaaatatataccattagttgttaattaaaaataaaaattttaaaaattcttaggaataaatttaaacaaggaagtaaaatagctatacactgaaaactataaaacattgatgaaaggaatttaaggagatacaaataaactgaaatatatctcttcttcaaaaattggaagaattggctgggagcagtggctcaagactgtaatcccaacaatctgaagtctgagacgagtggatcacttgaggtcaggagttcgagaccagcctggccaacatggtgaaaccccatttctactaaaaatacaaaaattagccagatatggtggtgtgtgcctgtaatcccagtaactcaggaggctgaggcacaagactcgcttgaacctgggaggtggaggtgggagtgagccaagatcacgtcactgcactccagtctgggtgacagagcgagactctgtctcaaaaataaataaataaataaataaaaataataaaatacaaaatttggaagaaagaatattattaaaatgttgatactacctaaagcaatctgcagtttcaatgcaatccctaccaaaattctaatgatgtttttcacagaaatgaaacaattctaaaatatttatgcaaccacaaatgatcctgaatagccaaagcaatcttgagtaataaaaacaaagcaggagaatcacagtatctgactgcaaaatatactacaaagctgtagtaattatcacagaatagtactggcatagaaacagacatattgaccaatggaaaagaatagacatcccagaaataaagtcaagcatttatgattgattttcaacaaagatgccacaaatacacaatggataggctcatcaatatattgtgatgagaccactggatagtcacattcagaataatgaaattagacacttatctcacaccatatataaaaatcaaatcaaaatgggttaaagacttaagtgtaagacctgaaactgtgaaactgctagaagaaaatggggggaacgctccatgacatgggtctgggcaatatttttggaaatgatcctcaaagcacaggcaacgaaaataaaaaatatacaaacaggattacattaaacaaaaaagcttcctgcagccaagaaaacagttaacagatgaggagataaaaataaaaagataattgatgtgtccaaaataagggacatagaaagaatgtgctgtgagttaatagattagagcagtggtgtgttggccattattttaacaactaggtcttttggaataaaagccctgacgtgtaccatttgccaatttcatggtgtaaatactctcaccatggctgatttcaggataccgacctgaggtcactgaatgccaagttgggaaatggtattcataattagattttggagtgatagttatagacagacatgacctgggcatagtttatggaggaggtcaaaactgaaactagtcttgaagattgtgtacaaactagataggtcaagaaaagtaggctacagatttgaggaatggtctaatcagagcccagaaataggaataaatgtggaatgtttaagaaaatacactcagtacatagtttgccaataaatatatttgtgcataattgaatggcagtcaatagacctgtctgatcggaaaaatgagtcttcataggtagcaacttgagaggatggctcagatgccacacaatattctgtggtaacccacagttctctagctttctgtataatgataattgaatcatcagaatcttcatcagctttgttacaaaggctcagaaattaccttgatctttgcttaatatttttgagttattttaataattatgcaaatgtctaatagtaaaatagaattaatagagaattctaagggagcagaaaattctaattttcaaaggttgcagagtggcttttcacagctatatatctacagaatgacattctctctactaaacaaacatgcctacagacattgaatttaatgatagtactttctttaaatataggtgggctacagaaaaaacctctttctcttgtctggtgtgtgtgtgtgtgtgtgtgtatgtgtgtgtgagtgtgtatggaattttgtggtttggcagggatccccaaactttttctgcaaacggctagctattaaatattttccgcattgcaaacaacgtggtcttggtcacagctactcgactctgacattgtagcccgaaagcatccattgacaatatgtaaatgaatatcatggctgtgttccaataaaaccttatttataaaaacaagtgggaaacatcaaggcatctagacaaattgacacttttaaaaattttatttttaattgacaaataataattacaggtatgtatggggcataatgtgatgctgatatatgtatatattgtggaatgattaaatcaagctaaaatggcaatcacctcacatatttatcattttattgtggtaagagcatttaaaatctactctcagcaatcttaaaagatacaatatatcattatttactataatcatcatgctgtgcagaagaccagtagaacttacttctcatgtctaactaaaactttgtacccttcaactaacattttcattgaccctattcatccccttccactcctgcacatcaccttgtgatactacgattctatttcctactcctacgagttcaaagttttttagattctgcatctaaagagattatgtggttacttgtctttctgtgcatggcttatttcacttaatgtaatgtcctccaggtttgtctatattatgatagatgacagaatttctttttaaatggtaaatagtatttcattgtgtacatatactgtattttctttacccatttgcccaattatggacacttagtttgattgtatatcttgcctattgtgaattatgttacaacaaacatggaagtacaaataactctttgacatactgatttcacttccttttgatatatagtcagaagtggaatgagtggatcatatgatgattctatctttagtttactgaggaagctccatgctattttccatggactaatttacattcccacccaaaaatgtgcatgtgttccgtgttctccacaccctctccaacatttgtcttttatctttttgataagaggtatttgaacaagtcagaggtgatatcccattgtggtttcagttaatatttcacaggttattagtgatattgagcattttttcatctgcttataagctatttatgtttggaaatataagtgttatcattttattgtggtttgctttattgtgcttcacagatactgcattttttttttttttacaaattgaaggtttctggcaaccttgagatggaatctactcctggtgtttggcaagtgtgttactcccatttttccaacatgtgttcactttatgtctgtcacattttggtaattcttgcaatattacaaagttttaaattattattgtatgtgttatgctgatctgtgaccagaaatctttgacgtgaccatggtaattgttttgggacaccacaaacagtgccaatgttaaaaaggtgactttaattaataaatgcatgtgttctaactgccccactgaccagccactcccctgaatctctccctctccttgggcctccctattccccaagacacaaaaatattgagattgggccaattaataaccctaaaatggcctctaagtgttcaaatgaaagaaagagttgcatgtctctcactttaaataaaaaactagggatgattgagcttagtgaggaaggcatgttgaaagctcacgtaggctgaaagctaggcctcttgtgcaaaagttagtcaagttgcaattgcaaaagaaaagttcttgaaggaaatgcaaagtgctactccagtaaacacacacaataagaaagaaaaacagtcttactgctgatatgaagaaaattttagtggtctggatagaaaatcaaaccagcaacaacatttccttaaactaaagcctaattgagagcaaggctctgactctcttaatcctatggagggtcaaagaggtgaggaagctgcagaaacaatgtttgaggtggcaaagcttggtttacaagatttaaggaaagagaagtcttcataacataaaactgcaaagtgaagcaacaagtgcaatggaaagctgcagcaagttatccagaagatttagatattagatgaagttggctatactaaacaatagattttcagtgtagataaaacagccttctattagaagaatatgccatctagaactttcacagctactaaggagaaattaatgctcaaaggataataaaggattaagcttcaaaggatagtctgatactcttgctaggggctaatgcagctggtaactttaagtagaagccagtgctcatttactggtctgaaactcccattatgaaatactctaaatctactctgcctttgttgtttaaatgaaacaacaaagcctgcatgatagcatatccgtttacagcatggtttactgaatactttaagcccattgctgagaccaactccctggaaaaacaattccattcaaaatattactgctcatttataatatacctggtcacccaaaatctctgaggaagatatactaggagatgaatgctgttttcatgcctgctaacacatatctatgttgcagcccatggatcagagagtaatctggactttcaaatcttatttaagaagtatattttgtaaggctatatattccatagatagtgattcctctgatggatctgggcataataaattgaaaaccttttggaaaggagtcaccattctagatgccattaagaacatttctgattcatggaaggagaacaaaatattaacgttaacaggagtatggaagaagttgattccaatcctaatagatgactttgaggggatcagggtatcagtggtggagataactgcagatatcatggaaatagcaagagaactagaattacaagtgcagcctaaaggtatgagtgaattgtggcaatctcatgataaaacttgaacacatgaggatttgatttttatggttaaaaaaagaaagtagtttcttgagatggaatctactcctggtgaagatactgtgaatgttttgatattgtaacaaagtatttagtatatcagataaacctagttgataaagcagcagcaggctttcagaagattgagtccaattttgtaagaagttttactataggtaaaatgctatcatacagcatagtatgctacagagaaatcttttgtgaaagaaagtatcaactgatgcaacaaatttcctttttgtcttattttaaaaaattgctccagccaccccagctttcagcagccatcaccctcatcattcagcagccatcaaaatcaaggcaagaccctcccccagcaaaactttgacttgatgaaggctcagacgattgttagcattttctagcagtaaagtatttttaaattaaggtatataaattgctttttaggcataatgagattgtacacttaataatctacattaaagtataaacataattttaattttaattttttttttcaacttttattttagaatcgggggacatgtgtaggttagctacaaaggtatattgcatgatgctgaagtttgggtatgattgaacccatcatcgaggttatgaacatagtataccttatacattaggtagtttttcagctgttatgcccctccttctctcttcactctagtagttcccaatatctatggctcccatctttatgttcatatgtagccaatgtttacctcccacttataagagaaaacatgcagtgcttggttttctgttcctgtgttaatttacttcagattatggcctacagctacatccacgatgctgcgaaggacatcattttgttctttcttatagtattccatggtgtaaatgtaccacattttctttgtccaatacaccattgatgagcacctgggttgattccataaacgtaacttttagatgcactgggaaacccaaaactttgtgtctctattgagatattcactttattgtagtggcctggaactaagcccacagtattttgatgtgtgcctgtatacatacattgtgaatgactaattcaaactaattaacattgcattacttcacatacttactttttacttttcgtgtgctaagaacagttaaaatctactttcttagcaattttcaagaatacaatatattgtcattaactttagtcatcacgctgtacaacagatctcttaatttactttttttttttttttttgagatggaatctcactctgttgcccaggctggagtgcaggggcacaatctcagctcactgcaaccttggtctcccaggttcaagagattctgttacctcagcctcctgagcagctgtgatcacaagcgcacaccaccatgcctggcgaaatttttgtatttttagtagaaatggggttttactgtgttgcctagcatggcctcgaactcctgagctcaggcaatccacccatcccagcctcccaaagtgctatgagtacaggcatgatccactgcgctcagcctacttcttatacttaactgaaattttggatcatttgtccaacttccctccaacccaccccagctccagcccccagtaaccatcctctactctctaattctaggagtttaaattttcttttgactccacaaataagtgagaccatgcagtttctgtctttgtgtgtctgactcattttatttcacatactaaactccaggttcatccgtgttgttgcaaatgagagggttttccttttttatggcagaatagtgttccattgtgtatatataccacattttcttaatctatccatcgttatcaatatttgggttggttttgtatcttgccttatatgaataatgttgcaatgaacttggaagttcagatatatttccctttcgatacatgcccaggagtggaactgctgaatcatatgatagttttatttttaattttttaagaaactgctatgttttcccaaatgactatattaatttacattcccatgaacagtacaacaattccttcctttttttttttttttttttttgagacgaagtctcaccctgtcactcaggctggagtgcaatggcatgatcttggctcactgcaaactctacctcccaagttaaaacaattctcgtgcctcagcctcccgagtagctgggattacatgcgtctgccaccacccatggctaatttttctatttttagtagagaaggggtatccccatgttggccaggctggtgtcaaactcctgacctcatgatctgcccgccttggcttcctaaagtccctcttttttttttttttaacatagtctctaatacttcttgtccttgtctttttattaatagctgttctaaaaggtgtgaagtaacattaatattatctcattgtggttttgatttgtgtttcctgatgattagtgatgttgagcatcttttcatgtacctgttggacgtttgcatatcttcttttgagaaatgtctatttacatcctttgcccaatttttaaaattagtttttctattttctaactattgaatcgactttttaatatagtttgaatattaaccccttatcagaggtatagtttgcaaatatattctcctattgtgtaagttgtctgtctatcatgttaattgttttcttggtcgcttggagatttttagtttgaagtaatcctatttgtctatttttgtgtttgttacctttgctttggggctcctctccaaaaaaatcattgcccagaccaaagtcttggaacttttaccatatgctttcttctagcagtttcacaatttctaatccctatatttaagtcttcaattcattttgaattggttttggatatggtgttagatatgggtccaatttcattctgctgaatgtggatatccaattgtccccaaacgactaattgcagacactgtcctttccccattgtttttggcatctttgtcaaaagttaattgaatgtaaattattggattgacttatgggctctcaattctgtttcaatgaacaataaatcttcttttatgccattaccatgccattataattactatagttttgtagtatattttgaaatcaggaaatatgatgctttgttctttttgctcaaaattgttttggctattcaggttcttttgtagttccgtatgaatttgaagactgtttttctatttttgtgaagaatgtcttggtattttgataggattacattgaatatgtagatttctttgggtagtatagtaattttaacgacattaatttttctaatctatgaatacaggatatctttttatttatttttgtgttctacagttacttttatcaatattgtatagtttcagtgtacacatctttcattttcttggataaacttactcctaagtattttattttttgatgctgtcgtacatggggttgttttcttagtttctttttgagatagttcattgttagtgtacagaaacactactaattttttgtatgttgcatttgtatcttgcaagtttacttaatttatcagttttaacagttttccagtgaattctcaggcttttctgtgtataagggcagatcatcagtaaacagaaacaatatcctcttcctttcatattttgatagtttttctttttttttttgttttgcctaattgctaattgtgtagaccttttaatactatattgaatggaggtggcaagagtggtcatacttaaatctttagagttcactgggtagttctagatattaaaaatggcaaaaaatttataccaaaaagtgatataaaaatgattatttaaaaagcgttcaatttatcttttctgataacattttattccagcactatgcttttctctcttatgtatgggtataggtggttgtgatgttggtattgacaccaacactttggtgttcatacatgttcttatacactgatttctgaataaaacttaacacagactgttacttaattctcattatatgagagttgccatgaagccaataaaaatctgcctaatgattttcctggataatggtcactttcttatttgattttatgtccatgttcctgtggacatgaatgaagagaagattttggtaaattaagtaaaatctttaattctcagtttcagtttccttatctttaaaacacgaaaaataactcctcttatttttacccaagaggatgatagtattatcttaatggcaggtataaatctgtgccctttattcattaactgtggtgagaaaattactgtagaggggacaaagaacactccatagcatttgtcagtcatgatttgatgctttattttctcctttcttcttgaaaatttcaagagtagacagctgaccttcctctgaatactttcttttctgctatcatcacctacaattaagtctaaaacctaatatatctaagacattacaaatgtaatggaagaaggctaataagggaaataaaagctccaagagaattaaatcacattaaataggacagttgggccatagtgcactctgtctggagaattaatcatatactattcaggccagtggaagagatcagtttgtacttccttatatgaaagtgtgttaggttcaaaaagagaagaaataacaatacaatttccagaaggaaagatgtattgatgacagatgtagtaggttagtgccaggcccacatggccttaaattcctatagcagttctgtgtgtccatcctcctgctttttcattctttgctcttaacaactttctcctgaagcctttagaaggctgcccttgggtactggggccacaaagcctatctggactcaagctcctgggagttttacatcccctacctcagggcatcctgtagccaatggctatttagcatggaagtacaaagactcatctgtctttttcttaaggtaggacaaactagggtatactttaccttctaccaggatctagtggagtcttggatttcaactgacattgtacacttattttacttttctttcttttgtatcctgcctaatccaccttcttttaatttatctttataaacactttctttattatacatttgcatgcaaattcttagcctaaggtctgttttggtgacaacctgatcacagacaatagactaccataacttcttagcttttatttaataacttaaatcacatttgataggcaccctctatttaaatccaatgagcacgttatttataaagaaatattaaccaacctgtcaacaaatgcatggtgaagaaggaagataggatcgttggcagatccctgtacctgggacattgttccattcatatagatgtgcaaggcattgtgcatgctgctttgagaggcatccgctatcccagtaagtggactagcaaatcctgttcattaaaaaaaaatgaaaaaaatatgtttactttaatgactgaaaacctatgtgattatcccatttgatttataactataacttgaagactgtttcaaaatataaaatcaaaaataaaattcattccgtattgagactctttacattctggatacccagtgtgtattcaataaatatttgtggaattaaatggcctaaatttgggtacaatggagagcttaaccaggtaaaagaggttgagccaatttgtgttccctcctgttcattctgcctataatttctgtttcaatatggacaagtcataggaacattttataataaccagcagtcactttcacttcagtctgtaacaacactcatagcagatcttttcagcctgttatgtgtccccttgctttccagttctggagaacactttaagtttggtttctggttccagagaaagcgtaaaatttgtgactcttcacatttcaattcctctttcacaggaacatctttcatatcagttcataatgtgtctgattttacaaaacattcatttcaaaaatattcagaactccaataaatatttccatttattgcatcagcaacagtaataatgggaaaaattttaataagagcaattattttctaaatgttgagtatgctaaatgtttattgtgacatatgttcttctatctttacagtaactctgttggttagaaattattatccctattcaaagaaaactgaggttcagagaagttctgagtttaccaagctacccaggtagagttgggattttaatccgtatcaattagacgctaagatatgagctcttagaattttgtgttctctctcatgtgcccattaagaagaggaagaggaagataactttttagtgcccactcaggcaaaactgagagttaggaccagaaaaagaagtttggataacaaaattgaattgtaagcaggaaccaagttgggggaacacgacgaagggcatattattaaatttcagaattaagaaatatcaagcaagcagaaattgtgaataagatcataatgtaaaccagagttacaacagaaacagtgaaaaaagacaggatttaggcagggaagttctagctttatttcatacaagtagaactattttattggcaatatcttccttattaaaggtgcagttcttaatttttgcatcacatgccttgtgctctcccactattgtgactgacagtgtttctgccccttcgggtagtgatgttttttcctccttttacctccttttgaacttattttattcattctgggagaccataccaatccctgatccctctgggagattagcctaagaacatgcacatccctctcctttacacagttttgtctatgacaacttctgtgaatatacatacatgacacttaatctgtgtagaaatttttctagatcttgacataattttatgtgacatttagaaggatctgaccaattaagtacctacattattatagaaatggaaagaaagggcttagaggggacaaagaacttgtctaaggtaaaataacaaattggacgttaaggttagagcagatgcctgttttagtgtagaacttatgctcctaaatacaatggtttacttcctttgctatgtagcaataaatcatgtcactgaggacaatgttcttcatagaagttgttttcaagattttatctttgagtagcaccaaatgaaaaatttaaaactctcacactttttaaagtgtatactctcacactttttaaagtaggtcccaaactgatttttttaatttaaaagaatttttaaagttttatatttttcattggtatgtaacaattgtacatatctttggggtacatgtgatattttgatgcctataatgtacaaggtgtaatgatcaaatcagagtaattggaatatcaatcacctcgatcatttatcttttctttgtgttgggaatcttacaaatcttctattctagctatttaaaaatatacaatagaataaattgttgttaactataattttcctactgcactatcaaattgttttaatcataatcataaatagtttcagaggatataataaaaggatattgcaaatagtgtcaatttaaaaatgaacatataatattactttcaaaaaatgtatccaccataattatttgattccatcatccatatcaaaaacaacttaaactcttctttgatagtctgtaactttctggagttacctttttatacttgaacttgtatttgtatactatttttctacacaattatatctaaatgttatatatgttatgcttaaaatatttgaaaaatattagtgaggattaaggagatgttagtctaaggatacaaattttttgttagataggaggaataagttcaggagatctatgtctaaggatacaaattttttgttagataggaggaataagttcaggagatctatgatacaacatggtgattatagttaataataatgtatggtatacttgaaaattgctaagagagtagattttaaatgttcttactactcaaataagtatgtgaggtaacagatattttaagtagcttgatttagccatttcccaatgtatacatacatcaaagcatcatgtgatgcaccataaatatatacaatttttatttataaattttaaaaagggaaaagaataagtagcctaccaaaattctctgtaacaaaaataggtatatcaattatattctaaattttaaaaaaataaataactgccaagaagctttgttcccataaataactagataagggtaaagaaatttttatttaaattttacttatctttttgaactcatttgagctaaatatgctaataatgatacaatccagcaaaaaaaaaaatagtttttacaatttgatccatcaactgacaactcaagcaagaattatttgataaaagcaatttcacaaatgatgaatttatttataaactacccaacttgtaagaagtttgttgcctagtaattaaagttatacatgttggcaacactagcaccaatgtttcggattccccacttgttaaacactctggaagtttttcccattctgggagcagactgtattgagaatgaattcaggataggtggaagataggctcttctgaaacatcagagaagggagattttgaaaggagagttggtgaaggagaatcttcaggagtcttctcaatcagattcatttggaaaagtatgcttggaaggatgagctaaaaataaattttcttaaaactctctgcaccatgtaccccttagaaagtttttgtgaacctgcagtagtgtatctatgccactttgaagatactgctgtaaaaaagatttttgaactgagtagaacttggcttaaattctgtgttacatactggaagtataatccttgtcaagttatttatattttttgggcttcaatgataagagaggaagtaaataatgtccacttatcagttggtggcaaggattaattttgatagcaggtataaaagcacctagtacagatctggtgcaaagtgaatacttcctgagtagtaactagtatttctataatcatgttgcatgtggtaaatagttgctgctaaccaagaatatggtgcactctcaatgcaaaagtatctcttttgctgcaaccattaggtaccaccctagcatcacgcatctccctccttcctaaacttcattgttctgtagaaacctgcctgctgcctgctctcatcctatatcaggtgttcttaggtgtcttaggaagtagaatggactgacattttaagagcgttttcagccaggctggtatttcattactcactactatactgacctgacagatgttgcatctagaaaagcccctaatattattaagaaaaaaaaaaaaacagctaaagaaaaagcacaaggaatttgtcggaatacattgtgatatgtgcttagaaataatgtaaaggcccaggttgaaccaagattctttgtaatacataccagattaatataaacagttgtaaacagttttattatagtaacaattttaaataatgtatatattgtctcttcaaatagactagagacacctcagaattagagatcaaattgtttgttttgatttccgataatcaaaatcagagacttgaacaccttcatatttaaaagataaacaaatataaaatactctcaatctttcacttatatatcctacagagattgggaataagagagacaatttccaaaaaacctacgagggaattttagagagctctactctggcacctgtcaagtgacaaaacagagaaaatgttatgaatgacaaataatataaaaatgtgaacaaactattttctattttatcttttcatagagtttattttcttggttggtgaagtcaacttgaaaaaaaatagaaataattactccaacatcggtagcttctctggctgagatttgactctgttttggaagaataagtcaaagaggaaattctaagtaccccaaaatagtgcccatatatatccagcttttcaaatatctttcatgtaaataatctcatttgaatctcagggctacttgtgatatgaatattatcattacctcagttttacaaatgtgaaaactacagcttatagaagttaaataacacatacattaaagctagtagttggggaatcaatgaactgaataattgattccaattcctgtgctcctttttgcatatacagttgggtagtgtctgtactgacttacccttggaaatttctttgcactatacccctgcaatgaatttgtggacttgtcatttttagctaccaaattacagcaaggtgcagaatgtgttattatctcaaccttgtccacgaattcctcatggaaagaaattttactgagccagtagagacatgttagtcacagatgccaaaatagctcaatgttctttgtgaaaggcagtaagagttcccccaaattatgttatgccttaacatttgcaagctacattcctataggaaattaataaacccagtttcaggtcaatggcaacaatagaattttttttttttaagatggagtctcactctgttgcccaggctggagtgcagtggtgtgatctcagctttctgcaacctccacctcctgggttcaagtgattctcctgcctcagactccagagtagctgggattacaggcacaagccagcatgcctggctaatttttgtatttttcgtagaggtggggattccccatgttggccacactaatctcaaactactgacctcaggtgatccacctgccctggcctcccaaagtgctgggattacaggcgtgagacaccgtgcccggcacccaacaatagaaaattgcaactagttgatctcttttgctcttttcttccctaatactactctgaaaagtttatgtttgtttctttttaatattgatgcttagctctcatacctagagattcagatataactggtttagaatgggactcaggcacttggagtttgaaaaccactccgggtcgttctaacatgtgaccagggttgcactgcactgaattaagctggactgatctccattctctaaacctgagctcatgcttcaaaaactacctgtgaatatatgatttccttgatatgaaattttcaccttctatattctgacagtccaaaaatccttctgcctttaaaatcttacactataaacttatgccttgacatattttcttcctggtaactgttccatgttcctttgaaaattatgatttaagaaattgagcaactactatgtaacagtcactggctaggcattggcacataaatcatctcatataattccgtatctttcctttgaggaagatgagttacagatgttgcactttaatcatacctgctaagagtctgaaatatgaaaaggtgtgtagttaaatcttcagaagaatagagcacatttaatttattgcatttcatttaagtgcatttttaacctattttaacatttcatagtgtttcagagatggaattggagaagaggaaataaaaagaagatagaaaatgtacattagtgcatctgaagattttttaaaaagtgacttaagacccactgacttatattcctccaatttactctcctaatgtgcaacttgattgaggaattaagtacacagcttcaaaaggttatgcacaatggttttaggaggctgtatttgatggctgaatactttgaaaaggcttgtaatttaaactacttacagaagaaatacagaattgcagatcaaaaaacatttttggatctaagcaagtccctagatacacgagaagcattaactttcaaccaacttccagtttgctcaaagtgctagctctacagccataaatgtaattaattagcatttatgtttattagaaaatacttttaatttgactcaggagatttctttgattatgaggaatagagtaacgaagcaaatgaagtggtgcatgagtgtttcatactatgtaattattacagcagagcccagggcacaaacactccacatattttgtgtttttcaaaaatgtggtcccagagttagcagcatcacctgtaaacttgttacaaacacaaatcctctaaccctaacagtgagtcactgaacagaaagtcaggtggggacccatcgtgtgtgttaaccagttctacaggtgattctaatgcaaataaggtttgaaaacagctgctctcattcttttcattgtttgcacaaagacaatgacaaatcacaatgaattataagtcatttccataaattcaagaaaggtttttgtgttattaaagtgtttattattttaagtgggcttctctacttgttaacctcggtgtttgtgttttctcttctctactacttaattgcctctctacaacaaagattactgctattactacaccttctattcctatgtggtaggtgctaggctgcatttccttaagtttttatagaacttcatcttcatagcaactctgtttttgttttgttttgttttgttttgagttttgtttttttgagacggagtttcgctcttgttgcccaggcgctggagtgcagtggtgtgatctccgctcactgcaacctccgcctcccaggttcaagcgatttttctgcctcagccttctgagtagctgggattacaggcacccgccacgcccggctatcttcgtagtaactctgtaaagaagatattatttaaccaactttcaggtgttgaaactaagtctcaaagaggataggtggtttatctaaggtcattcagtaatgatatagtttggatatgtgtcctagcccaaatgtcatgttgaaatgtaatccccacttttggaggtgggacctggtggaaggtgatttgatcatggggcaaatttctcatgaatagtttagtaccatccgtttggtgctgttctcacaatagtgagtgagttctcgcaagatctgatgatttaaaagtgtgtggcacctgctacccttcacgctggctcctgctctggcgatataatgtgcgtgctctctgccttctaccataattgtaagtttcagcctccccagaagccaggcagatgtcagcactgtgcttcctgtacggcctacagaactgtgagtaaataaaaccattttttttttaattacctagtctgagatttctttaaagcaatgtgagaacggcctaccacaagcagataagtggcagggtcagaattttggccaattatctgccaaacttccaagctttgctcttaattattctgttacattctttcagttgatataaagccattagttgcaataaaatttaaaatagacaatagatgttctgttgcagttatgatagttcctttatttcctttaattcttgtcatatccattggaataaaaagctgcaacccagctttttcacagagtactctcttggggtagaaaaggccctatcatgctggttcttactctctggatgaaaacttcatcagcttcctatcacaggactccagggcacatagtcaactggatcagagaaggcaagaatttttggtagtgtcaccaagatattgtataagacccaatacccacatacttatggccaatttttgttcttatcaaatttaatttttttactagattgtaagaatttgtggaaggacataatttcatcctaaaggttgcttttaaaagcattctatcaggccgggcacagtgggtcacgcctgtactcctagcactttgggaggccgagacaggtggatcacttgacattaggggttcaaaaccagcctggccaacatggtgtctctactaaaaatacaaaaattagccaggggtgatggtgcatgtctgtagtcccagctactcgagaggctgaggcaggagaatcgtttgaacctgggagacacaggttgcagagagccaagatcgctccactgcactccagcctgggcaatagagtgggactctgtctccaaaaaaaaaaaaaaaaagtcactctgtcattctgctgctctttacactttggatataagtttaatttaggactaatattttcctgaaacaatttttgtccagtttgagtctcaagtcctagtctattgtttggaatttggcttctatatagggctagaaaattacagtgtgtgcatcagcatgcaagacagtaactttaaggaactttcattattgcaataaaaggatggttctaagtaatttacaaatactgacttatgtaatcttcacaatagcatatgaggtaggtattgtgattattatcactttgtaagtgagggacctcaggcaagggcaggttaaatttacaaaagtcatttaactagtaagtgatagtactagaatttaaacccaggtagtccaactcttaactgcttttctctagctgcatctaaaacttggcttttctatttggaacacttgaggacatgatctcccttgctaatgatccatgttttctacctgttagctctgtaacattgtcaattggataaattatcagaatctcagtttcctcatttataaagtgtgcataataataaatatggtataaggcatttaagaagaataattaagataatggacgtgaaaagtttttagaaaagtaggattgtagtgatgttaactgttgttattaattacagaggctatctggtaatttgtaaggttattttgtaaagatgtaggaaagaatttgtcaattttcctccttttcttctttgtactttactgaaactattccagctcattcttggtgatatcagatcatccataaaaatttctttgacaagaaatatttggttagcttccttcatttaatgacacttaaatttgcctcttttaatcatttattttctttggattataattagtttttcacaatctagttcttaattatattaagtttcaagagggcagaatatgtcatttattcctagtatattgcaaagtatctataaatgttttttaatcaataaacatgaggcatatatttctctttctaaaacatgtagctttagttgctggcataattttaaaatcaattaagctaacttttttgaagattcctataatgttctaaggtttatgtctttgagtaagattgacgatagctttgaatttaacccttatgtttttatgttataggcctctctcaatagtctcctgatggaataattaagtgaatagagagaaagccctgaacaacctacatgaaaaatagttttggtgttgttcagcatggaggggataacagtagatgttaggatagaagaggtcgatgattcttcactctaaaaaagtagttaatagaaataactattcacccataaaacatggaataataaatttttgggaaataccatggggaaaaaagaatatataatgattatggaaaacagaatagcatgatctttttccatgtagtagaaaatgggataacatgggaaactatttcagaaagagtagggcagcaagcaatggtaagaaagagaaaattatctattctttcacagttaagaatcgaggcttcagtgaaaatgaggcaggccagcccaggccagaactaaagttcaggaattactggatcctagagggaaaaataaaacaacgaagagactcaaacagaaacacccaagacacatccattcactgtgttcaaaaaaccactttcccttaactcctggatgcacaatgaacctcacatttatatgtggccctgtgaataagtagtggtcaatgacatgtaggcagaaggtatgtgggccacttcaaggcttggcccatatatttctcatgtacaattctccatgcatcctcatactcagtctcccaggaagatggagaagatacatcagataagtgggggacagtagactcactaacatagccatagggaaggtcattccccaaccagaaacatccaaattggattttggatgagcaagaaattcatttttattggattacatcactaagattttggcatacgtttgttaacactgcatagtattacttactccaatattctctacttcctaagttagataataaatgttcgcatttttaataacttgaaaggtctggagttaaagagagactttaacacttcatttaccactacagaactaatgttgttttacatgaaatttaaaacaacactgtgacagaacattatggtaagagtgcttgatttttgttttaaatactttacaaaacatgggtaaaagattgtgacagagactactacttttttcacaaatgctaattttttctctttttcctaataataatctaaatgttgttggacacatggccactagctggagataacatcttccagtttaagctaaatgttaccatgtctgtttgatcatgataagaaacacttctaaataattcctttaaagaaaaatagtcatacgctattcttcccactttcaccctttcgattagggtgaaaacaggatgaagatcaagagatggaagctgtgagttaaggatgacagaattgcactaccagatcttgaagatctaacttcatattgtttcataagagcaaaatcaacttctttttcttaaaaggcatattatttgggtttacctattttttttttttttttttttttgagatggaaaaactccatccaggctggagtgcagtggtgcgatctcggctcactgcgacctctgcctcctgggttcaagcgattctgcagcctcagcctactgagtagctgagactacaggggtgcatcaccatgcctggctaattttttgtatttttagtagagatggggtttcaccatgttgcctgggctcgtgtcaaactccagagctgaggcaatcagtgcacctcagccttgagttttcttatgataccataaagtgggccccatttaatagaaggtgaaataggctaattccacaatattccatgaaatgaatggcagatagaacctcagaaggaataatctgagccacagttgcttttagtatacatacaagtcatatttcttactctgtttaagtgccatcctttaagtatttcacctataaatctgatgctttttcttactgcattttcttctgtttatttatacactaaagtcacaattccaggttcataagctttcaccaggttcataagctttcacaccttctattggtaagtgaagtcactcactgcacaaaatctgaatttactgcaggatgaaaaagaaaaataaatatggtttcaattaaaattattgattaaagataccaaaatcctagtatgttgtataaatcctaaaaattattttcttcattataataatatagtaacagaggttttctatgtttaacaaacattatcttagttgataattacataaacagatagaacagaaatattatcttcaccttataaataaaaaacatgagctgtatgaagttaaatgacttatggagggtcttgcgtctttagtattaatgatctctctccaaaaatggtgggattcttatgacatttctaaacatttcttagtaacactatgaacactatttgattgacaggtgcactcaaagcccagacttcaccactgtgcaatatatctgtgcaacacaatcatgattgtacccctaaatctataaaaaattttaagttaaaatagattattttaatggattgcttagactcaaatttttaaagccaatgggatatagccatttattctttgccaaagcaataatttttattttattttattactattattatactttaagttctagggtagatgtacacaatgagcaggtttgttacataggtgtacatgtgccgtgttggtgtgctgcacccatcagctcgttatttaaattagatatttctcctaacactatccctcccccagccccccacccccaaacagggatgttccccatcctgtgtccatgtgttctcattgtttaactcccacttatgagtgagaacatacggtgattggttttgtgtccttgtgatattttgctgagaatgatggttttcagcttcatcagagaagtcagctataagtagcctatctcaactgcaagcttctcccaagtaattctttataaaatatatagatattatatcacatcatagtgcttaactgaattttgtgcttatttcttttctggtttgcttatgcttctcctcactagaatgcaaatattttaatagcaagttccttgtctatctagtaattgtgtgctaagaacgttgttacatatatatttttacaatatcgtactaaaaatcaaagctgtaactttagatggctacaaatattagcaccattttatggtgagaaaaagaaggcttagggaagaataagcagcttgccaaagattatgtagctagatgtagcagctttgggattcaaaatgaggcatgtttgatgctaaaatctatgttcttaatcacatgatttactgcctcttagtctcctgatttctgggcttttgatttactttagagctctgttcatcccttggctctgatatttggtgctatttcagtgggtctgacctgtgagttcatccattttttatggctgcatagtattccatggtgtatatgtgccatatttgctttatcctgtccattattgatggacatttgggttggttccaagtctttgctattgtaaatagttccgcaataaacatacacgtgcatgtgtctttacaatagcatgatatataatcctttgggtatacccagtaatgggatcgctgggtgaaatggtatttctagttctagatccttgaggaatcgtcacactctcttccacaatggttgaactaatttacactcccaccagcagtgtaaaagggttcctatttctctacatcctctctagcatctgttgtttcctgaccttttaatgatcgccattctaacaggcatgagatggtatggcattgtggttttgatttgcatttctctgatgaccagggatgatgaggattttttcatatgtctatttgctgcataaatgtcttattttgagaagtgtctgttcatatcctttgtccactttttgatggacattagccctttgtcagtttgatggatggcaaaaattttctccagttctgtaggttgcctgttcactctgatatttcttttgctggcagaaccatctatagtttaattggatctcatttgtcaattttggcttttgttgccattgcttttggtgttttagtcatgaagtctttgcctgtgttctcaacggtattgcctaggttttcttccagggtttttatggttttaggtctaacatttaagtctttaatccatattgagttaatttttgtgtaaggtgtaaggaagggatccagtttcagttttctacatatggctagccagttttcccaacaccatttattaaatagggaatcctttctccattacttgtttttgtcaggtttgtgaaagatctgttgtttgtagatgtgtggtgttatttctgaggcctctgttctgttccattagtctatatatctgttttggtaccagtgtcatgctgttttggttagtgtagccttgtagtatagcttgaagtcaggtagcatgatgcctccagctttgatcttttttgcttagaattaattgtcttggatatgcaggctctttttggttccatatgatctttaaagtagttttttccaattctgtgaagaaagtcagtagtagcctgatggggatagcattggatctgtaaattattttgggcagtatgaccattttcacaatattgattcttcctatccatgagcattgaatcttcttccatttgtttgtgtcctcttttatttccttgaaccatggtttgtagtcctctttgaagaggtccttaacatcccttgtaagttggattcctaggtattttattctctttatagtaattatgaatgggagttcactcatgatttggctctctttttgtctattattggtatataggaatgcttgtgatttttgcacattgattttgtatcctgagacttttctgaagttgcttatcagcttaaggagattttgggctgagacaatggggttttctaaatatacaatcatatcatctgcaaatagacaattggacttcctcccttcctatttcaatatcctttttttctttctcttgcctgattgtcctggccagaacttccaatactatgtgaataggagtggtgagagagggcatccttgtcttgtgctggatttcaaagggaatgcttccagtttttgcccattcagtataatattggctgcgggtttgtcataaatacctcttattattttgagatacgttccatcaatacctagtttactgagagtttttagcatgaaaagctgttgaattttgttgaaggccttttctgcatctatggagataatcaagtggtttttgtggttggttctgtttatgtgatggatttacatttattgatttgtgtatgttgaaccagccttgcatcccggggatgaagccaacttgattgtggtggataagctttttgatgtgctgttggactcagtttgccagtattttattgaggattttcgcatcgatgttcatcagggatattggcctaaaattctcctttttcggttgtatctctgccaggctttggtatgaggatgatgctggcctcataaaatgaattaagaaggattccctgtttttctattgattggaatattttcagaaggaatggtaccagctcctctttgtacctctggtggaattcggctgtgaatccatctgatcctggactttttttagttggtaggctattaattattgcctcaatttcagcacctgttattggtctattcagagattcaacttcttcctggtttagtcttgggagggtgtatgtgttgaggaatttatccatttcttctagattttctagattatttgcatagaggtgtttatagtattctctgatggtagtttgtatttctgggggatcagtggcaatatcctctttatcatttcttattgcatatatttgattcttctctcttttattagtcttgctaatgttctatctattttgttgatcttttcaaaaaaacagctcgtggattcattgatttttttgaagggattttcttgtctctgtctccttcatttctgctctgatcttagttatttcttctgctagcttttaaatgtgtttgctcttgcttctctacttcttttacttgtgatgtcagggtgtcaattttagatatttcctgctttctcttgtgggcatttagtgctataaatttctcccgacatgctgctttaaatgtgtcccagagattctggtacgtcgtgtctttgttataattggttttaaagaacaactttatttctgccttcattttgttatttacccagcagtcatttaggagcaggttgttcagtttccatgtagttgtgtggttttgagtgaatttcttaatcctgagttctaacttgattgcactgtggtctgagagacagtttgttgtgattctgttcttttacatttgctgtggagtgttttacttccaattatgtggtcaattttacagtgtgatgtggtgccgagaagaacgtatattctgttgatttggggtggagagttctgtagatgtctattaggtccatttggtccagagctgagttcaattcccggataaccttgctaattttctgtctcattgatctgtctaatattgacagtggggtgttaaagtctcccactattattgtatgggagtctaactctctttgtaggtctctaagaacttgctttatgaatctaggtgctcctatattgggtgcacgtatatttaggacagttagctcttcttgttgaattgatcccattaccattatgtaatggccttctttttttcttttgatttttgttagtttaaagaccaggattgcaacccctgcttttttcttttgttttgttttccatttgcttggtagatcttcttcagtccctttattttgagcctatgtgtgtctttgcacgtgagatgggtctcctgaatatagcacatcgatgggtcttgactatccaatttgccagtctgtgtcttttaattggggcatttactccatttacatttaaggttaatattgttatatgtgaatttgatcctgccattatgatgctaactggttattttgcccattaattgatgcagtttcttcatagcattgatggtctttacaatttggtgtgtttttgcagtgtctggtacccgttgttccttttcatgtttagtgcttccttcaggagttcttgtaaggcaggcctgatggtgacaaaatctctcagcatttgcttgtctgtaaaggattttatttctccttcacttaggaatcttagtgtagctgaatatgaaattctgggttgaaaattatttaagaatgttgaatattgacccccactctcctatggcttatagggtttctgctgagagatctgctgttagtctgatgggcttccctttgtgggtaacccaacctttctctctggctgcctttaacactttttccttcatttcaaccttggtgaatctgacaattatgtgtcttggggttgctcttctcgaggagtatctttatggtgttctctgtatttcctgaatttgaatgttggcctgccttgctaggttggggaagttctcctggataatatcctgaagagtgttttgtaacttggtcattctcgtcatcactttcaggtacacgaatcaaatgtaggtttggtcttttcaaatagtcccatatttattggaggctttgtttcttttcattcttttttctctaatcttgtcttcttactttatttcattaatttgatcttcgatcactgatatcctttcttcctcttgattgaatctgctattgaagcttgcatatgtttcatgaagttctcgtactgtggttttcagctccagcaggtcatttaagctcttctctacactggttattctagttagccattcatctaaccttttttcaaagtttttagctttcttgcgatgggtttaaacatccccttttagctcggagatgtttgttattacccaccttctgaagcctacttcagtcaacttgtcaaactcattctccatccagttttgttgccttgctgatgaggagctgtgttcctttggaggagaagaggcattctggtttttggaattttcagtctttctactctggtttctccccatctttgtggttttatctacctttggtctttgatgtatgtgacctaaaaatggggttttgctttggatgtcctgtttgtttgatgttgatggtattcctttctgttagttagttttccttgtaacagacaggcccctgagctgcaggtctgttggagtttgcttgaggtccgctccagaccctgtttgcctgggtatcaccaatggagcctgcagaacagcaaatattgctgcccgatccttcctctggaagcttcgtcccagaggggcacctgcctgtatgaggcagctgtcggcctctactgggtagtgtctcccagtcaggctacacggggtcagggacccacttgaggaggccgtctgtccattatcggagctcgaacgctgtgctccaagagccactgctctcttcagagctgtcagacaaggacgtttaattctgcataagctgtctgatgccttttgttcagatatgccctgcccccagaggtggaatctaaagaggcagtaggccttgctgagctgcagtgggctccacccagttctagtttccctgctgctttgtttacactgtgagcatagaatcgcctactcaagcctcagcaatggtggatgcccctctccctgccaagctccagcatgccaggtctatctcagactgctgcactagcagtgaacaaggctctgtgggcacaggacctgctgagccaggcatgggagggaatctcctggtctgctggttgcaaagagcatgggaaaaacatagtatttgggcaagagtgtactgttcctccaggtacagtcactcacagcttccttgggctaggaaagggaaatcccccaaccccttgtgcttcccagatgaggtgaccccccatcctgctttggttcaccttctgtgggctgcacccactgtccgaccagtcccaatgagatgaatcagatacctcagttggaaatgcagaaatcacccatcttctgcattgatctccctgggagatgtagaccagagctcttcctgttcagtcatcttggaagctctcccaaagcaaggatttaaactcaactgaaagttgagcaaaaggtcttacctttgttcttactttacaataacataaatagtggccataaaaattgattgatatggaaaatctttctttataaagtaagcaacaaaaataagcaattgctaatgctggtggataaataaaaacaaagtaaatacgtctaagaagaatgattacaaagatcattagatatgttttagaagtacttacaaaattagggatttgggtatatgttagtgattaaaattatgatgcatattttaaggagattctctgtaaatgatccatagattcagatgaattgcatactcactgagcaattattttattctctggcacaataattattcatctcaaattggcagaaaacaaagtgataatagctgtttgtataatgtaaaatttagaataaaatatatattggaagtcctccctaagtcttttctcacatatattgataactgttgatattatcttggatgatgttacacattggttctcttgatgtttatgcatcaagaaaggtcaataaataaaagtaagtattgctccttgcttgactgaaatagggttcctaatacgtcttttatctcatctatctatttaaatgtaaatttcaaatatttgccttaaagaactttgtctttttaaaaactttttttcttttcttgagacggagtcttgctctgttgcccaggctggagtgccatggcgcgatctccactcactgcaggctccgcctcctggattcacaccattctcctgcctcagcctcccgagtagctagtactacaggtgcccgccaccacatctggctaattttttttgtatttttagtagagacgggatttcactgtgttagccaggatggtcttgatctcctgacttcgtgatccccccgccttggcctcccaaagtgctgggattacaggcgtgagccaccgcccctggccttaaaaactttttattttgagttaattatagaattatatgcagctgtaagaaataatagagagaaatctgatgtgctccttattcaatttccctcaatggtaaccttgaaaaaatattatgtaatatagtagaatatcacagctaggatattggtattgaaagggtcaagatacagaatatttacatattgaagcagtttggtatttttggaataaatttcatttgtttcaatgcataaaattctttttatatgcagctgaattatattcgtcaatattttaagaatttttacatatatgtacatgagggatattgatctgtctcattttcttggcatccttttatctggtttcaatattaaggtaatactggatttataaaatgactcagaaatgttcccttctacattctggaacagattgtatagaatttatgttaatttgttaaattcctggttgattctcaaggaaaacattctattccttaggatttctattttggtagttttaaaattaccaattcaatttcctttacatttatagggctattcaagttgtctatttcttattgggtgagtggtatagtttgcgcttttttaggaattagttcatttcatctaagttgtcaaatgttatgtacatagagtgctcatagtacgcttttattacccttttgatgtctgcaagatctgtattgatatcccttttttgattcttgatattggtaatttgtgtcttttctctttttcccttttcaatcttgctaattcgtcaattttattaatatttcccaaaaaccagctgcttgttatattcatatcctgtattgattcctgtttttaatttcactgctttctgctcctatctttattatttccttcattctctgtgctttggttttattttgctcttctatttctaggttctggagtttgagtttgtattactgacttgagactttacctctttccacatgtgtgcatttagtactatacttccccctctcagcacaattttatagtatgtctgacaaattttggtaagtttggtttttaattttatttatttaaatgtattttattttccttaagtctttctctttactccttgggttatttagaagtgctttgtttagtttctaagtgtttgaagatctttccctcatgttattgatttctagtttgattccattggggtaggagaacacagtctgtataattccaatctttttaaatttgttgatatttgctttatggctcaaggggcagtcatatgtttagcatatgttttatcagcacttcaaataaatattttttgttgttgttattgaatggaatgttctatcaatgttgattagattcttctggctgatggtgttaagttctttatcactgcagatgttttgcctagtcctgttggttaaacagcagtattgaattctccaactgtaattgtgaatttgtctatttcttccttttagctctaccagcttttgcttcacaaattttaagcttgtttggtgcatacacatttaggattgtgatgtcttcttactggattgactcattaatcttgataaaatgtgcctctcttactccaataattgtttttgctctgaagtctattttattagatattaatatagccactttaactttgttttgattaatgttttatgattttttccatcctttaactttcacaaatattgttatatctaaagtgaatttcctctaggctcaatataggtcatttttaaataaaatctagtctcccaatctcttaattggtatttttagactattcacatttaatataagtattatataatgttatggcttaaacctatttttttcctgtttgttacttttctgaattttttggttcatttttcctgtcttcatttgagttgcttgaaaatgtttacaaattccatttttatttatcaagttttttgaatgtatttctttgtatcactttattggtgatttatctaagtattacattatttttacataatttatctctgctggcatcatccttcaactagttcaaattaagtgtaaaaccttatttgtcttaaatatttatcttatgttcatttagatgaatgacataaaattttatttttgtttcaaccattaaatcacaatttagaaaactcaacagaagtctgttgaattccctatatttttgcttaagaaagtttattttatcatttgccttcttcttaagaaacttctattaaccatttttttttcagggcaggtctgcttggtggtgacaaaatcttttcattttacttcatctgaggagaccttgagttctccttcattcctgagtattttccctgggcatagaacactgggttaacagttcatttttttcagcatttgaaaaatgcagtgccaccttctggcctccatagtgtcaaaggaaagatctgtcattcatttttttccacaatagataagatataattaatttctcactactttgaatatttgttttagtttttagaagtttaatagtgatatattttgatgtggattgctatgggatttattaaattgggtttaactcagattctttaatttgtagtttcttttgctaaatttgggaagttttcagtcactatttcattgagttcttagaactgatttttctcccctctttctaggacgctaataacacaaaagttcaatcattttcatgtagttattcaactctttgagcctttttaattttttttccagtgtgttttctgtttttcagatttggtaatttctatttttctatcttccagttcacttattctttcttctttcctctccattctgctgttgaacctagtattgagacttttactttggtaactgtattttttagttctaattttgttttgttctttgtgatatcttccattttcttgcgaagtcattctatttttttcatttgtttcaactatgtttataattattcattgaggaattcaaaaatgagtgttttaaatctattaacttggtacaaacgtaattgcggttttcaccattctgttcaatggcaaaaaccacaattacttttgcttcaacctattatttgagataattttaacatatctgttacttcagtgttaacgtctgctgtcttttttttttttttaattcaaggatgtaacttttcttagtatgataagggattattttctgttttcaacctggacattttgggtattttatgagactacagatcttattaaatcttctgttttataaaagtttataatctcagctgggcgcagtggctcacacctgtaatcccagtactttgggaggccaaagtgggtggatcacttgaagctaggagttgggagctagccagaccaacatagtgaaatcctgtctctactaaaaatataaaaaaaattagccgggcttgttggtgggcacctgcaatctgagctactcgggaaactgaggcaggggaatcccagctactctgggaggtggaggttgcagtgggctgagatcacgctactttacaccagcctggacaacacagcaaagactccatctcaaaaaaaaaaaaatgtataatctcctggctttctctgactcagctccagcagaagggaaacactgcattattacttttaagtagcaatagaagtccaagttccccaccgacctggctccccactaggcctctactgatgtcttccttgctaggagaggtaagaatacccctcattactgctcctcaactactttcccctaatgccatggattgggtggcctaattaccactagacagtgctagaagacctaactatccagtaggcctcctctgacaacaatccagaagggaagaaaggattcctctttttactgcctggtggggatagaattgcaggtcctccacattgcctccatgtaaagtaggaagagtggttaattcctccctggttggaatgcaaactgagccttctcttacatcaccctggaagggaattgaggaggcaccttgttatagcctagtaagggtagaagtctagtctccccagtcaacttttgctgacttgggtggggattgtgcctcagtttttctgtttttgaatttgaatgaaatagagtagttactgtttaaaacttttctgcacctttctttgtcatttgactagagagagaaggcttttgttggtgtttttttctttctgttttgttttgttttacttttgtttgtacctctgggtgtttctaggttacaagcttcttcagctccaaatcttgaatatatgaggaaaataaaacccaggggactcaccatcataccgtgagatcccaatattcctagctgacctggcttcttctcttcactatttacattctttctgtttcttttatatgccatgtccagagattgtggttgtatttagagggactaatagagaaaagtgtacctactttaccttcccagaagtagaagtctgtgttgtatacttttgttattgacaatcatgtttctgttttcccaccaaaatttcattgtttcacacaagaatttcttttagatacctactctgagcagagtggttagtgttgggtcatataccagaggcagggttgggagtttatcagagtcctcagctttactttagcaggctgaagaaggctttgtagtgaagtggaatttgtatcagccttggagtcagatgaatttggaatagtagacttaactatggttgttatcaaccatgtgactatcaggttccctatccgtaaaatcaagggaaaacctgtctcatggtgtaattgcaaatttcaagtgatttatttgaaaatgtacaaggtatcaggtgctcaacaagtactaattttgttttctctgttgctcacttgtaatgtggaaatgcaagtatctattactttcttactttaatatagccaagctttttagatatcaaagaagtctatttatgttatatgaatcaaaggctaatgatcagacttgcaaattgaaaacaggccactccttttacactagagattttactaaacagaaaaatcttttcatagaaacagcatcatttttttctgtccttgaggtaagaggagcttgcaatgaagagaagtataagccatgaaatagcgagtttttataaccatatttctacagttgattataaaatctgctccccctccattaattattacgtcttaagaaaagaaatgtgaatatagtaaccagctatagagcagagctgccctgtatgcctgatcataaaaatcatctgaggcatttactaaaattaaagtttcctaggatccagctatacagtgtgtgtgtgtgtgtgtgtgtgtgtgtgtgtgtgtgtgtgtgtattatgaaaatatattctagttttggccatgaaacattatcaacatcaacacgttaggactgccaaattggcgtatatgtaaaaccctaaaaccaagtgaacactaatcacatctggaatcaatatatgtgccagataatttgtaatagccaattagatcacgtttgggaaacacaatgacctactatttactataaaaaaaaaactgcttcattttcatagctcaacagtgtgtgcttttactgtgcaattttcatgctgtccctcaactttccaaatactagaaggttgtgtgtggacctcattctgttgagggccctcaggatgcacccaatccactgtagacaacctcaacagccaccagagagagaagcaaggtgactaatgtaccattgcaggaaaacaccttttaccctgcccccacaaaaataagtgtgtgggtgtgtgctctttgtattgataataaggtttaatatataaatacaaataattatgtgatatatctatatctccacacacacatatatatataacattattatataagtcactgtggctcactggaggtcataaacacccccacttccactgccagacctactgaaccaaaatctctagaggaaaggcctgataatgtacgttgttagccaccatgtctttttggatttcgcaaatgtgcctttagatatcaacattctttgacatttcatcctgaaaatgcagaattgtatttgaaattaataaggtcttcccagatgcccttatttttaaaaaagaaattattctacaatcccaatattttattgcttaacaaaatggggccaacagaccccttgaagtccctgaaactctttcagaggatttgcaatgtcaaaactattttcctaatgatactatgatgtgattttgcctttttctgtgttcacatttgcactgatggtgcaaaagcaatggtgggcaaatcttctggtgtcttagcacaaatcaaggtagtggcaaccaagtgtactgtaattattatattcttcaccagccacagacttgcagtaaaaatgaataaatgcaagtttcacttaatgtccataatgaagcaaaacaattttttaaactatctttttttacatgcctttttaattttctgtttcacaaaatggaacctacatatgcactatttatgctgcattctgaaatatgttcgtctagggaaaaaacatttgtgccattatttgtgttgagagctgaaataatcatgtttcccacaggaaatcattttcacttgaatgtaggattcagagataaactggctatttagacaggcatttggcagacttcttatgtgaacaaagcaagtctgtcacttaaacagaaaaaaaaagctaatggtattttttcttttttgccaatgctacaatttgagttttcaagcaaaaatttaaattaagaaaaattgatgacatcattatgagcttgtcaatgtcttcatacttaaagatatttctgatgagattggtggtgatattaataatgtgattttgaatattgtataatgagatattttaacatttggaagatcacttaactgagtattttacaaatgaccaatgcatgctattataaaatcactaatgggtaaaatactcattcatgatgctagacagatcaatggactttaatgtagcaaggacaaaaagttcattgatatgatttcagatttgacagtgtaattaaactctgaggaaattaccatttgtgaagttttagtatcaaaaagaaaggatctacaattatctgaaaatgtttttaaaaatacttctctctattctgattacatagttgtgtgaggctagattttcatcaagttcttcaaccaaacaataaattataatatattgaatgtagaagtagtcagatgtagtgtgtttttaaaaaatataaagtaatctcattccacttagtatttttgaaatattaaaattatattatttatactatcacataacaaattaattttttaaataaattaatacaaatatgcaagatctttttatttcagttttacaaatgagaagtagtcataaatataacccacataaataaaagctggcagaaatttttcatatattgtaagagttataaatggattctgaaaccaaaatagtacaaatcattagtgtagaagattacaaagcagtcctatgtatgcatcagacattgttaatttgtctttgataccttgaagttaggccaggtgtggtggctcaagcctgtaatcccagcattttgggaggctaaggtggtggatctcttgaggtcaggagtttgagaccagcccagccaatatggagaaatcccatctctactaaaaatacaaaaaaattagcgaggcatggtggcacacacctatagtcccagatactcgggagactgtggcttgagaatcctttgaacccgggaggcagaggtttcagtgagccaagattgcaccgttgcattccagcctgggctacagaccaaaactcctgaagtcttttaactcgtatttgtttaataaatgcataaaatagagttataaattttatttgcaatatgtattgctaatgtgtagtgatatttttcccaagacttatcccaaggaagtgaaatgtctatatgtcttaatgcctgactctatacttagaaaaggtgtattattattttgctccataaagatcttctaggaccctcaattgaattcttggaaaatgacattatcccttttaaatagccattttccacagcagtgagttcaaatcatgaaaaattaaacaaaagctctttagcttggataaatacacatcatgaagactgacagcctatgctaaattataagagaagttgagaagactattgaagattacagagaaggtggcaggagaaaaagggaaacattttttgtgtatgtaataggagctagatgtacataaattctcatgataacctgagcatgtaattattgaagaaattttataaatgaggaagtagatgcccagaattttagaactgatactgaaatccagttctatatgtcttcaatatcagtgttttcattgaccctaaaggactctgcactaatctgggaagtttctctctttctctctttccagtgaatcttcctaagacagtacttgccataagataatacctgcaccttttaattcagagtgaagatgacacaaggcttacataaattcactttactttgtcaatattcatatttggcatgaacaataaattgcatatgccagtacaactagattcctcagggatctagaactagaaataccatttgactcagccatcccattactgggtatatacccaaaggattataaatcatgctgctataaagacgcacacatatgtttattgcggcactattcacaatagcaaagacttggaaccaacccaaatgtacaacaatgatagactggattaagaaaatgtggcacatatacaccatggaataccatgcagccataaaaaaggatgagttcatgtcctttttagggacatggatgaagctggaaaccatcattctcagcaaactatcacaaggacaaaaaaccaaacaccgcatgttctcactcataggtgggaactgaacaatgagaacgcttggacacagggtggggaacattacacaccggggcctgtcatggggtaggggtaaggggaagggatagcattaggagatatacctaaggtaaatgatgagttaatgggtgcagcacacaccaacatggcacatgtatacatatgtaacaaacctgcatgttgtgcacatgtaccctagaacttaaagtataaaaatatatatatatatatatatgagaaaaaagttaccttttgagtaaaatgagtggaatgagcttataatgtaaggacagagactgtctcctaaatttattagaataattactttgctgagaatggtgctttagtttaatcaatgaaatgtcctaggactgttgtgaggactaaataagataacatgtgaggagtattaatgtctggcacataggaattcttattgttattatcaggattattgcctgatcagaataccaatgtggttatcaaggtggtaaatctgggggattaattaaaacaggcccggaaaggttttcctggtctggcaatcatctttcaaaaccttctgcctctctcggagtcagggtacaccaaactactgagtttctgattccctcagaattagtgaggaagatactagggaaatagtttagccttccaattactagaatgcgtcactccatgttaactatctccttggctatctagtttatacaattagtgtcaaatgaatttattttttgaatctgtgtgacctttttttttgttgttgttgttgcatgaactaaggaagtccatttctcaggcaggaagactgaaaactagattacctatggaggcttcattgtagttttccagctggcttttctctgcaaatacacacactattcttgtttaaatgtcattaaaaatttcaaaacttcccttgtttctcattaaagcccacagctcatttaccactctgtagattgctccttaaaaagtccttgcatgtgaagtggtgaaatagttcctagtgaagtgtttgatagtgacattgaaacaaaaagagctgaagggctgcagaaaaaaagttaaggttctagagaaggaagcataatatcagctttataagtgctgttatatgaagagaaattacatttttaaaatgacgtatagcttactaggacaaaaacaaggaccaattgttagaaatcaatcacagatgtgtcagaatcatcctgaacttgttgctttccttgctgccttacagtcagtcaccgagagcttctgattctgtatactaaccaactcatcttcatcctcattctcactactttagatcaagctctcatccatgactccccccaatagctcactgattatctttctgcattctactaatgccactaacatcatatcttttgaagtataggtaggataatatcaattccttgtttaataacctatcacaactacccttgtcaatggcatgttttcaaggcaaatttttcagacatacttttgaagataagaatgttatggtttttaaacattgggtttttatggtgatgacagctaacatttaatgtattacgaatgaatttataactctttaaaagtgaagatttgaaagaatcttagaataaacttcagtttcttaattctgtagggatttgtgaacatattcctagaggcctataatgtgtttttttccttcaagaagattgagagacactggtatacacggatttttctaaactccttacatctcttgttatttcccactacaaactcaatattctagccacgtagaacttctcattttttggtaactcatctcacactttcacacctctgtgtcattgcatatgttgttccctctgctggaaatgcctctcctcctcttctctgctcagtgagcagttactgatatttcaagatccaattctattttcacctccttaggaaatatttctggtgtatctgggttcctacctcattttatatcaattaccattttatgtatttacgtggagtttcttcacttgatggtgagcttttcagtaagataagctgtgtaagtcatctttgtatttttttgtacttccatagtataccataataccaggttcatggatggctctatttaagtcgaatggaattagattttggtttagcctaaagaacttcatgttttcccttgtggggtaggttttcccttgatgggtcacatggtggtgttatcccaatgggcatcttagcatagtgtgggatgtcggactgaatatactgagaagtctcctccaatagtaagtttccatagtcataaactgcatttgttagaagggggtggtttgaaacaatatatgatcaaccaagattgacttggtcctacctatgattaatttgattttacactattcttggtatatgtaagttttacaatgaaggtagttttcttttatttattgatttatcagtctgtcagccaatacttaatgagcacctactataggcagccactgtgctcagaattggaaacacaccattaaacgccaagaagttgttccttgttcctgtctcctttttcccttttgggtaacagaagatacctttgttcctgctgtcacctcatttttgaaacttgtcctgaaatcctatctgtctccagaaacattatttatttttggttctatcttcatgaattttccatcctcccctttcccttatttttccactaaatgtaggccattataatatattttctcaggactcactgtaaacttactttgttaagctaattgccagagaagttaatgattgctaagttgtcagtaactaaccacagcttaacacaatactgttgtgccctttgttgaaaaaatgttctaactaccttatatgtattgcatcatttaattctttgaatcttatacattattattgttatccacattttacatatgagaagttaaataacatacccaaggtcacacatctaggaagtggttgagctaggatgtaaacctagtcagtttgattacttttaaccaattcattgaaatttcagtccccatgtcccattctccaacagtgctattaaaaaaataaataaaagaaaaagtaaacaaaaaatctcttgtaaactctgaaatacaggacataatggatagagagtttcatgagagaaaatttctgttttaatgtgacaactgacactgcacagggtcccctatttaacctaatcagaaaacttcttataatacagacttatttttctttgctttatctagaaacatgaggtttttattttatttttatttatttatttatttatttatgggaagagtctcactcaggctggagtgcagtggcatgatctaggctcactgcagcctctgcctcctgggttcaagcgattctcctgcctcagcctcccaagtagctgggattacagacatgtgccaccatgcctggctaatttttgtatttttagtagaaacggggtttctctatgttggccaggctggtctcaagctcctgacctcaggtgatccacctgccttggacttccaaattgctgggtttacaggcgtgagccaccacacccggccatgaggtctctcttacacaattcacaaattacacatcttcactatttcagcaatgaaatctaagaggaaagctgagtttacttaaataacttcagtagacaaaaataaaacagttcctttgtcctagcaatgactatgaatattttgttccatgggaagtgcattatacacttctcacgagaccaagaaagaaaaggaagcaataactttgaggtataatcaaaagtaacaattccatttcatatgcatttattgagagagcagagtataattttgacatttgctctcctctcaagtcctactgtcctcactgctatattcacttgtgtactccttatagaccaagacaccccacatccctgtcctattcatgatgtgagataaaatgtgtctctctggtgaggaaaacttgcttccgaatcttgatcttgagtttccttcccaatgaaagaaaacattactccttggagtcatggctaatttcaggcctggagcattgtaggtacaagatgctctagaataatttgcttaccagagagaatgtgtgttttaaaaaatgtgtatatgaaatggagacataagaaccagcttgaaggtgtaccatgggcaaattctggaaccattggaacacaaagataattaagcacatcaatgagttatacactatcaaacaatggaaagcctttactccataccattaatatagatagatgatagatagatagatagatagatagatagatagaaaaaatggaggatttttgctaatagtagaatcctgaatattggctaataaatttaaaagcagtgctgaagttgaaaaatcataaatttgtaaccatcgacgatgccaactgtagaagaaattgtgataagaggtgaggtatttgcatagtcttaaaatgtctccatgtagacagtttattaaacaaggggaagaaataattatacagtgggaaaattggaccacatctggagtaggtgattaacatcaccaacgtgagacagatggtcatgatgtgcctccagatgtgacaccatctcagaaagatgcataatcacctatgtggaattttggctaatagtgcattacctggatctagtcatgaagaaatattagatacactcaaaatgaagaatgttctattaaaaaaatgaggaggaagaggaggaactatatcctccagagctgtcaagcacataaagacacatatgtacaaggttatggaaatatttcagactaaagaaccatgaaaactaaatgctatttgatcctagactagattctattttggagaggaaaaatactgaggatattattatatctaattttaaaaactgatatacagtagatttgataaaagcattatatcaatatagagtttactgaagttgaaaactgttctgtggctatatgagtctattcctattcttaggaaatacacactaaaatattcaggggtaaagagttacagtctatgcaatttacccttaaaatggctcagactgggagagagagagagagaaacaggatacaatgtaagtaagtttgggtaaaatatatattcatgttttttgtattgcttttattttcacaacatctctgtaagcttaaaattattgctgaatacaaatttaagaaaaaataattttaaaatgtgtacctggtaaagaaaagttcttcttagcagctgagcttaatggtttctcacattttctctcatgacatggacttcatacaacaggcatggataaggtaagtggtggtttagatgcaatttgaaagattctagctattatttacatactcggttatcagatacttaccgaacgactgtgtgccagacaatatgctatgttgcatctgtttgcttctcacacactttgcctactaaagtgtgtaagaatgagaataaattatgggaaaaaataatttacaaacataaattatttgtagtagcaaattatttgtagtaaatctgctgttccctcctcacctgtgtgtattagactctcacttgaaaaccactggctgagttgacacatcttgagccactttttttctttgacttgagaccctagacgagtgatgttcccctgccttatttctgcaactaacccatgcttcttaataataaaatatatgctttgtcacttatggctgaaaaaacagcaaaatgctccagtttccttaaagatgtagcttcgctttgcaatgtcattaatatcagcattctgagtactgttgttaatccctgaagagtccagtgggtcacccaatcctcccagatggtgactttgaaattgtgtaccttagatttgttatataggctctgagattacctggcattatgtcttgccttcttatgtcaaaagaccaaactggtattgtccactttaaagaaactctcaacccactgttgattatcagagtgcaatggaaagaacttggactttggtacttgataaagctgggggcagattatctccaccacttttcaatgggaatcaataaccaaaagatgaatatctctgataatgtttcctcccttaaaagtgggaataataaatacaatcttcctcaggggatagttattagaattgagtgagttaatgccatacaaagtgtttgacatggtgttttggatacggtgattactttaaaaagttaatcatgaatattaccatagaagaataaacctaatttctattttcatagctggaaaacagaattcatctttaggatgagacttgccttgcttcagttgattctggatgtaagaccctgagattatggttttgaataaaacagggaaatgaatgaaacagtaaaaccactctgcacagtacaataataaaagttggggtgtaaaacaatgacaaaaaggaaaaaaaaagaacaagtcaaggagaaaggattacaaaagagaggaaagtttttctacatgttaaggtgtcacaggccttttaggagctgcgatgtctagtgttaaattttgagttgtctgccttgccacaagtcagtgcctatgtcttccccaaactcctggtaaatttgtgacttgattgagtttttttttgtttgtttttgttttgttgtgtttgtttgtgattttgttttcctaatgcaaatttatgtgagtgaaatgggtttcatgactgagtcagctataagcagaaaagaatgaatcgatgtttgaatgcaaaatgcaagcaagatgaaaacatttgtaggagaaatatttaggagttagagaagatcatgagatgtaatctctgatgaagaacagaaaacttaagggataatgagagggaggctttacctatgtgctgtgtccttattacagttaaatgaatgaacttacctcaaagaacccactgcctagaatattttaaacaggagaaaactaaaacactaaaacgtaggaaaatagtatcagtccacagacttatatctgaaattccacaatacaaaatgttctggaaatgaaattaatttttctcttttaatggaaaaaactgactttactcaccattaggttgcctattgcctgtatttattaccatgatgaatatattcatatatttcactaaagctgctactgctgcttcttctgcttctgctgctgcttctttcctcagagtctctcactttgttaccgaggctggaatgcagtgacacaatcatagctcactgcagcctgaaacttctgagttcaagtgatccacctgtcacagcctcccaagtaaactgggattacaggcatgagccaccatgcctggctcctgaagctaacacgttgaattataacgtgctgaccagtgtcagctagggtcattgtcgatataagtatatacaacacatattcttggtcaactcagaaaattctgaattctcaaatacctcctaggactttggataagagactgtaaatatgaattcagaaaaaaaattaaaagtgaaaagaaagagattaccttccagtgtatttctaaagctgaaattggcagctttatccatggaaccagattcatattgggtcaaactcaggcaaaattctacatcagctgaagaggggagccttggggttctggatttgtcatggtttccaggattacgccgtaaaggtccctcgggcgttccattgcataaagactgatggctgttgtactcctccaatcggctacagacaatctgtacaaaacaccctcatgttaaacaaattgtcaccaccactgagtcagtaggagaaggcagaaatgttggaactcctaattatcgttgttagacttctcctgaggagattactacaatcatgtgtctttaatgacagggatatgttctgagaaatccatcattaggtgattttgtcattgcgtgaacatcatagtcagtgtacttgcacaaacctagaatggtatagcctactaaacatcttggctgtttggtaaaacctactgctcctaggctacaaatctgtccagcacattactgtactgaatactataggcaattgtaagataatggcaagtatctatacatctaaacctatctaaacatgtaaaaggtacagtaaaaatacagtataaattttttttttaaatggcatacttgtatatacaggacacttaccataaatggaccttgcaggactagaagttgcattgggtaagtaagtgagggaataaggagtgaatataaaggcctaagatactactctacactacagtagattttataaacactatatatatatcggctacattaaatttataaaaatatttttcttttttaatgataaattcaccttagcttcctgtaacttttttacttaattttttaaaactttttgagtcttttgataatagcacttagcttaaaacacatattgtacaactgtaggaaatatttattatatccttagcctataagctttatgctatttaattttttacttattataaacataattgaaatttcgttaaaaactgagacacaagcatacacactagcataggcctacacagagtcaaagttgtcaatatcattgtcttccacctccacatcttgtcccactggaaaatcttcaggggcaatagtacacatggagctatcatctctataacaatctctataaaacatccaggcgttttgtggaacacctcctggagagcctgcctgaggctgttttacagttaacttacttttttataagtggaagaagtacattcgaaaataatgataaaatatagatagtaaatacataaaccagtaacatagttgtttattatcattatcaagtattatgtagtgtacataatgctatgtgctagacttttatacaagtgggatttcagtaggtttacaccagcatcaccacgaagacatgagtaatgcattgtgtataatattatgactgctatgatgtcactgggtgacaggaatttttcagctccattatagtagtgtgggacctctgtcatatatgtggtccatccttgacagaaatgccattgtgtggcatactactgtattttagaattagctttttgaaggttacagaatgagccataaaagttaaaacctggaacaggattctagtgttgcatctaccacttaagaaaatgatttaactgtctaggcctcatctatcaaatgaagataataacaactacctcacatagttatagaaaataaaatatttattaaacacctattatatattaagcactgtgccaagtgctgaggctggggttggtaacaatagagataggcatcttactgtatataaagcccatagcacatggcatgaccaacagaaaacactcaataaacagtagctttaaaaacattaatctatattatattcagaatgtcaaggactagaaatagtttcattttgtgctttttgttcataaaatatcctattattgtcccttttttttttgatgtgcagtacaatactcgtggttgattgttttttaagaaaagaaatttctctgatcctttagctagaaccaaggtgattttcattgtagaaataccgtcttaaaaataagaatttctcacctttctataagcaaaactttttaagaaaacacggcacatgcattgtttcatttacatcacaaaacaatacatttcgcttcacaaataaggaaaatgagactcagagagggtaagtggcatttctcaggttatatggcaaataaatggcagtgttgtgatggcaacccaagttttccaacttcatctttagtgtattttgtgcttttataactagtctagcagaactcaacattaaaaaatttttaaaagtaggttctaggttaaaataaaatagagagttctagtcctgtatctcagttgtggctgacaacaggatgttgttctttgttggtttccctaaaccttgatcaaatttttctaaataaactgtcttaatataacttggtttgggtatctatttcctactgagatccagactgatgcaaatattatttcctactgatctttccctttccctctcttctataacttcactggcctctttgcacttcccaaaactcaccaatcactcttatgcaacatgttcctgtactggttattttttctgggtagactgttttcccttgatacctgcttgggttattcatatcttcattatcttaatgaaatctacactaaacatctatttaacatcatattcagccttacccactttagcagtgttgtagagctggttagcactagctagcaaaagttcaaagtgtgtaacccttctcaatattagaatgttcagcagtatcccatcattagatggaaatctaccattgtcagtatttacaccacaacaattggcaaatcagaatcatctctccctactttcccactcctccattgagaacaagttattaaacatttactgtacaccactaatttctgctttatctgtgcacttagcaccttctaacaaactatgtaatcaaaagaactctcatagaatgattgatttattgttgctgcttttcaaaccgaagttttaaaatgtctatgtgtcaggcattataccagaatacaagaatacatactgaacacgataaacatagtttttatttttatagagtttacagtctaataagtatggtcatgaagatttaatgtctataccatattgccttattcattgacttaaacatttttaataagtattagcattttaagtattgagtactttatgtaacttaccttctagtggagtaggtctaggaagtgtgagtgggtgagacagtaaaacaatatatataacttattatattttttaactcctttaacttttttaaataaaatattatatataatgttttactgtctcaccacacacacttactagacctactccactagaagataagttacataaaatactcaatacttaaagtgctaatatttttgtaaatgaatttttaaatcaatgaataaggcaatatggtgtatatatttaatctttataaacatacctgttaggtgataaactctatcaaaatataaactgtatcctattcactatgtattattgtgtaatggtatggtgcctgacacaaagacatttgaaaactttggtttgaaattcaataacagtaaatcaattattctatgagaggagttcttttgatatttccatctcatcaatgagaaaacaggcttatagaggttaagtggcttcatcaaacatttatagtttataaaacggggggagttaatatttgaatatagactacatgatttaaagcttaaatcttagcaagtatcttaaatgaaaattccatttcctggctacccattcccacataaaggcactctagtcatcttcccctgtcatctcttggccaatgagtttgttatgaaccttcaaagactccatattataaaatccaattatccctgcaagtccccatgttaagatagcattaggcacagttgaccactttcattttcacaaaacacattcctctatgtactgatttctataatcacatcccctttgatttttgcctttctctcttgctgttactacttggtgtgtcctactagctcttcctcgtctgtcttacctgtaaatattgtggtgctctaggcaggactggctatgcaatttgcagcaccagataaatgttgaggccttggctgggggtagggaaatcaatattcactttctcaatctacagggaataggtatcccacagtctcagtctatagtgaataggtgactccctagggattgaaacctccatgctaagacttgtttgagtaggtgggtagattagttcaggctgccataagaaaatactacagactgggtggcttaaacagcagacatttattttctcaaagttcatgagtttggaagtccaagatcaaggtatctgctgaggcctctcttatgtcttgcagaggaaaccttttctctgtcttcacattgccgtttctctacgcatacacaaagaaagagatggctctgtcttttttgtcttcttatgaggacatgagtactgttggattaggaccccactgttaatgacctcacttaagctcaattacttccttaaagacctacctccaaatagtcacactggaaattagggattcaacacacacgtttttgggagacacaattcagtccataatactgggtgagaggtctatatgtaatcacctgtgcaccgtgctaaggtgcagccagcctcggtagagaaggcctctgttttactctgaaccaacaaatcatgggatcaacacccaacctcacacctctttttgcttgcaccaaggaccccaccagggatggagagtgacagtgaaatgttgacctctttcctcccaccagtggccttgggcagagggtgaggaggtggaaactaggtagggctggtggatgggtagtggtagccaagacccatcccaggaaaacaaagaacaaaaggtctgcaggatgcatatgaaccaagcatatgctccattgtccctataacttcacttataaagcacaaacccaaagataagattaataagaatttcaacaccaagaccacagatcattaaacctcaaatgtagggtctgcttctgagcatggagcattgtgcgatggcactgcttttatattggcaattctacctccaaaaaatatctcgagtcaggcaaccattctccatgtgctcacatcctgtgtgatcctgctgctaaagtcagatggcctactttctctggacactgcttgtgcttctccattccatgactctgattgtggctaagcatgcccactctttgccatgcatctaatatcctacccattctttaaggccaaagcaaataattagtaaaaacaggcattgttgactctgactttaaaagtaactcaaaaggggctgactctgaatgtaaaaacatttcaggaatccttcaccaaattatttttcttgtagtttcatttatatgtaggcagaagaataaactatgataaaaatatgtgactacgtaagccaaaaagggcttttaagataaatatatttttttatttttcttagtggtacataaatgaatgcatcacttaaattcattgataccttagatttaataaaatagagtaattaggtagtgagagatacattcgaagcaaaagatgaaattcaggagagtccaccctgccgtcattgactgttcacaacaggtgcatgcttccgtgggaggcttggggccactagggagataacattgttctttacccaacttacacttactcattttcgtctctaataaacaatgattgttacgtcccttataaaaacgcatccttcatgaagacacatttatttttacattgttgtttatttcttttctctcagaatctagtacagtttctagcaccctgttgatgtgcagtaagaatttgttggatgaatgaacagagtcagtggatgagccaaagaatctcctacaaaaagtatgtgttgagtgctcatttttcttggtcatgttgttggtaccacctctaccatagaatatatttctagaacttatttttttaaacctatattgagtcactactctgtcctaggccataagggagatatctccatatacattaaaattagaaattctcacaactaccctgtggatttttatgattttatctctattttcatgatgaggatactaagccagactgtggaagactacaaaaggctaacgggatataaagacccatgttatgatttataattttgtgaacagtaggcgagacgtatagaataataatttgaaggtaaaatgtcttcccggtcaactgtttgcatcacatttgaaaataatcaagactattttattggtcctcctatcccactgaatttgctatctataagcatgtataaacaaatgtagtcatctcaaatagaattgaatgggcagtccccccaccatagatggctgctactgtgttagataagaaatgcttagagaacctactcttaatttttggtcactaagacataacttaagaatttatgcattgtgtggtagagaaaaaattgggctccgtaatacaggtagatgcaacttcaattctggctaattttcttactggcaatgaacatgttttttagacttgctaaatctcaatttttttaaactgtactatgacataatatacgaaaagaaactattcaacaaataatttctgtttcaacaaatgccagtttctagtttgccttatacctcataacgttcctaaatccttttatccatatataattgagaactagaactgttgagtgacttgtcttagggccatatgatatttagagtcaaaaccaaagcactgaaacacaagtttccttattctgaagcaatacccactacattaattatgacgtgttaatggcttaggaatggttgaataaaactaacctaacttttacattgaatgtaatatgttggatgcttttataatttgggttaactggacgctacaagtatgtagactaaatcatttttattcctctttgagtaatctcaggatattttcaaaagatcctgctgccttaaagactcctacagccaactcagttaaattagagaggcttgaatgaaactatttttgctgaaatgccaactgccaagtgactaagtgttcggatgactggaggtattactaacgaggagaaaatctaccctggttccagaaataatttgaaaaactccaaaccttagtctttacactgcatacaggagaggaggcaggctaggagaaattatattagcattgtgcttatgatcatgaagattctagtcagaaagacctggtttccaatactgaccctattagttacatggccttgggcaagttacttaagctctctgggtattaagttttttcatctgtaaatgggaattatacgtttctatcaatgatcaaataatctaacatgtataaagcacttagcatagtgccaagtgtaaagtgtttaataatgacaactatcataattatttttgaaaacaagaccattgggcaggtcaccaaattgtttttaactttgggtgtataacactgtttgaatattcattattatatctaactttgatgtatcatttaaaaatatattatttccacacatgaaactcaaacaataggtcagatcctaaacaagccatataaacacatcttattgaatcccttcacagtaatgctttaacctatattattctaattttagggacaaaaatcgtctcagaataattaagtaacttagggtcttgtagctaagtaagtatgaaagttcactcaaattcatgctgatgtgactgaaaagactatactctttccactacattattctgtttcccattccatttaatcctcctattagcacacacacaaaacatgtatagatggtaattctacctcattttttttctctttggaaaaaacaaaggtcaaagattttaaataactggtccaatgtcgtctactaaatggcaggggtagaatttgagcctggatgttctgatgatgactctgttttttttctatttcaacgcaagtgatttataacatatgctggggggacgatcaagtgttccaagtcaaagaaaaaaggggagatagaagaaatagatatattaatgaggaaggtgaacctaaatactgttctcttaaatttaaagaaatagcaataaactgccagatattaaaagcttttgggagcaaagattttgttatagcattagaggtttatctgggggaaaaaatgtaaaccgtatgacattccacaaaatctttttcataaagaaaaaagagaagctgttatttcactgagctgtcgtcatggttacctaaaacccatgactctctgctgaaatgtgactttttttcttctctttgcttccatgtgatgtgcttttcacctgatgagtgaattccctggtcacaattcactcatgtgtatcagctaggaaatgttttttcctctttgtttctgttcatgatgacacctattcctgataccccttttatttttgtagctagctgatctgttggttgcataacattagatctaattatattgagcatgggtagtttgtacttaaatgttattaagcaaccctccacctccaaatataatgaactattttaattgatgataaacatggcccctaatttaaagctttgggagttaaataaatgagcaaacaacagacatgaattaggaacacaatatttccaaataaattaattacctgattttaacatatttaacagaaaactctgaccaataaatattaacttcatttaaatcacactcagctatgttgcaccttgcttcatcttctctcttgtattgtctttctttgcatgcacacacgcagacatacatatggaactaccagagagaacgacacaagatatattatacccaaatttgagtaagtggctactgttgacattgttgtatccttggcattgggaatccagtgctataaaaaaactgcagtgaatggtcctagaaatctacccatgcagagtttaatattttatgtatgttagcattggagctaacgtttctttgatgttaaattcagcatgtatttataaagcctgttccatgtgtatattatagtcctgtgctctgtggatacaaaaatatttagaaatgatcaccaccttggagcgactgacaggctggcagatacagacaggctggaaaaccactacatgtaatgaaaagttacaagtgctatgatacaaatctgtataaagtacaatgatagcacaaagacggggagagggtcaactctacctgagtaacagaggtggatcagtaaaagtctcagaatattttcattatgatataaattaaaaggactacatcactgtgtctgcctatgttgtctggggcaggacaattttaagggagtcaacgtgatcaaatgtcaaattatacacccagaaattagcgggttacttgaccccttctgaacctaaatggatccttataaacaagaaataacattgttgacttaaaaagcactgcagtcagagccgcttggttttagtcctcagatgtgtgactttggacaatcatcctaccattttaggcttttctatagttttttaataaaatgcacaggttaccctaaataaaattgaagatctctcagctcagagttaataaatgctatcaaatctctcaaatctcaattttggggtcaagtaaaatgatatctgaaaccaataaaaaaagaaggctttatgtgaaaggtgcatcagcctagctaatttggaaggtcttaactcaatctagaaactatttgatctcatctcacacaaatagtctagttcttaatttaagcattcaatttggacaaaggcattcaaattaatggtgtgtttattacagaacatgcgtttttgtaaagtgaaagtaaaaagataccaaaacaatctccattaactcaatgattctcagtgctggctgcacattagaatcacaaaatgagggtttaaaaatgcaaacacttgaaggcccagcttgatggctcaggcctgcaatcccagcactttgggagtctgaggcggacagatcacttgaggtcaagagttcaagagcagcctggccaacagggtgaaaccccatctctactaaaagtacaaaaaattagctgggagtggtggcgggcccctgtagtcccagctactagggagactgaggcagaagaatcacttgaacctgggaggcggaagttgcagcgtatggagattgcaccactgccaaaaaaaaagactcttgaactttacaacctcacaggagaccacctgaatctgaatttctggcaagaaattaggtgcataaaaaccttgcaacagttttttatttttactttttaaatggttttttggaagcttcctaggtgattttgacattgagaactctgaattaaagcaatgtaagcaatcgatcttaactattttaaggactttgtaaccagagaggctgtgtgaaggaatggaaacagccaatgtgagtggggtttgactgtcacctttgccactaataagcccttgacactactaaaacatagtaggtgagcagcaaatgctcatttcacctttcttaaactgtggtttgcttgtttctcttcagtcatcttccttccactctgttttctaattttatttttgaaacctgtttctacacagcaatttaatcatagaacaaggttgaagttgataattgtatcaatttcagttcagggcttactgacttgacacacttttttttttttctagagagtattaaaattgaacacattcatgaagagagaaaaaggaaaaagttctgcttgacaattaataagtaattaggaaaataatactcatacagttgtggatagcatctggtattacacatctcatgtaattaaaaattaatgtgtatctatctattaagatttcctgtggatgttgcagcttattttggtaatttagacagtcctccaacctttctgggtcaagttaagccacatagttaaataaagcatcataactgactgaaaatcccatgtccaatcctggcagttttttaaacaggaacagaggatataagagctagatgagagtttgcacattatagattaaggtaggaggtctgaaagcttattgaaatagatttttttccaagcacattttttctagcctttcctgcacaaaacccattacatttggtaaatagctgactaataacaccagaaattatacagtggctattttttaaatgaacttcagtagactccattgggatggggtacaaacttggttgggcggagaaggccatctacatttcaaaactgcagattgtgggaaattgagtgcaagattcttcccatcccattcacatattgggcttaatttcatagagcattgctagtcaaaagtgctgtattagaaatttttggaagacaggcagaaaagcattcctttaacatatggttttaaaatgataaataattaagcacatatttctttggttaccatttgcccctaattcagaatgaaaaattcagaatagatgaaataggaattcaattccaaatagtaatgcttcatattttatctaaagttttcaaggactgagaaagaaagctaacttctaatgcagcctaaagaaaaagtgagacagaatgaaccagatcctttagctaaagatatcacagcagtcacatccttggaaataggatacagtggtcatacagctggactattagagaataaatgtgattttttttttgctgcttattagctgtatgatcttatacaggttacctgatacctttataacctctaaaatagggaaagactgataagagcatgaaatgaacgaatgcacaaaaacacttgccacggggtttgcacatgctagatgttcaatgaatattagccatcttcattatttacctgtttaagcctcaggatcttcatactttcaaaaatgaagatctaatccaataattatttcccaaacattcctgattaaaagaatcaccatagacatttagtaaattgtgccttctcgggactctctcctgaagattctgaccaattagtctgggataaggccaggaatttgcatttttaatttgtacaccatatgaatcctgttgtgaataataattttatttttcagagacattagtgtatatcatttgtttttttaatcatccagatattcattcattcactcatttattcaattcacaaaatacataatgcactattgccatttttaaaggcaccatactatgttctgggaaatgcaataatgaatcaagtactctgttcattgcagtttagaaacctagtagaagtcattaaacaaataattacacaaatatctaaagtgtgctataaaggaaaaatacaagatacattgagagttcttaacagggcaccatttctgtccttgatgggggctgcaatgagtgttcaggtgagaagtttataccctgcctgaagaagtgattgttaaggttcctccctactctgacatcgtatatctagcatatcttacctgccaagaggagaagaatgatgctgggctgagtaagttaggatttgtggggtgctgacctcccatgtactcatctgtgcaaatgtcacacttttctgcatcccgccagtcccaatatggaatagtgaagttttcatctcctgtcagcttctggatttcttgttcccaccgcaacaagaagagtctatgccaaggcagaaaagctggtgcttcatgggcaaaatcaatgtctctccagatttcagatcccccaagcagtgcatccattgacacataataatgcatccagacaaagaggtcataaatattgatgtcgttaaacatgggtgttgatccatttttcatttggccataggtccctatggggatgacatagtctgagctgatggtatgctttgctaaagtgaggtaggcaaaaaatttgtccttctctggggcactcaaatcgaagatgtttcttctcaccaagagtcgtctctctgtgcagtttggtccccaaaagccaaacttgcagtttccacagttgaatcccatgaagttgccagagcactggcaggtcctattataaaagacggaaggccacgactcccggtcatccacccctgtgaagggaaattgaggcccaagtggtgcattggacagaaggatattctgacaggaacctctgcctgaaagctggccacagggactcctgtccccgctccacggtggacagcattccttctccatcaggttcttagaggagacacaggctctagggaaatggccagcggaggtctggaaactccacagcaggcagtacaaaacagccaggagcattcttcctctagtcctcacaaggtctgcaggaactggctaattggagtcacagatttctctttccagctactactacagtgattatcacatgtcttggctgagacctatataataccactcccacctccagcatcaaacacttttagtctttatcttaagctttcatcctctgaaaagcacatgactgacttttctttcgaattggctcgtatcccaccagtgggataggcctatgttaaagtgaaaaactctattcaccattaatagtttaattcttatggttagaatattaacaataaggttagtaataataatgcctgacctaagcaaacccagttaatagactacaaaactaatgatgatttgaccttgcaaatgagaggtagtgtcaggaatagagcttctcttattaagaaagtttaggaagtattaaagattatgggtttaaggtagttatttctcagagaccataaagaggctacaatgtttgaagaactcaatatgcagagagagattgtcttcagagcccagacagaattccttatatgttattgaatttcagtttgtttattttatacaacgtatcagaaaaaaaaatctttctgatacttttctctgataatcctgatgcattttctgacaactcctaaggatagctcactttgataactgggcgatttgcttcattgtggggatatctcacgttaaagagctctctctctctctctccctctctctctctttctctctctctctccctctctctctctctctctccctctctctccctctctctccctctccctctctctcccctctatcctctctctctctcctctgtctctctcctctctctctctcccctctatcctctctctctctcctctgtctctctcctctctcctttctctctctctcctttctcctctctcctttctctctctctccaatgctgtagccatattgtttttcctatcaattctagaaattaggaatttttttgaaaatgtttttgcaatgtgttttgtgcaaagacattctcaattagtgagtgaatgaaaaaggagaaatatatttcttcagcaaatatttttgatcatctcaattatttcaaaagttccttctctgtgtatagtgagctagggaaactgaaattcatggctaaaaatacaacttaactatgttagttttcaaatgagtagtatagataattaagtcaaacttttaatggaagagatgtatttgtgggctgatattagaaagaattgcataattttgataataatatgcaagtgttatcaagggagtgccttgattaatatctcaaagagtgggcataagttggacagacaactgagaatatatacaactcctgagacaggggaaatgtgtagaggtgggaactgtgtttcatctatcaagttggagcattaaactgaggcctccacacatcatagaaaattaaacctgggaccaatctatggaggggcttaaagactttgtgttttgaactaaagtgagctcttttgtgagctgaagagtgacaaaaagagtagtcaaatcaaagttgcccctctgaagcttccttctttgtcctcttccatacttaaagtttgggggtccactgaaattaatgaaaaagtaaaagaaagtgaaagctttgaggagatcattagtatttgggtccttagctgaagcattctaggaaaagccatcactatttcgatgatgccggaatgtcagactgctctgcttttttctctttttctggagtttgtctcattatttaagaaaaaaaaaagtcacggctcatccaaacaacttttttgagacagaacaggctttgcaggtacatggagcagtgtgtgggtgaagaggaagagaagtttccatggaaatgctgcctctggctggaatcaggaagtcatcacatgatctccacaaggaggcttaatcttttctctctctctttctttcagagccacaaagagattaacacaagacttcttgtccctggggagccttgggtctgcattacttgtaaccacatgtggcatttcataattcttttctatgttctcgaagacagaattcaacttatcatgttcaatttaattaagaattttgccttacacttgccccactatcaggcttccagtgaaataacttagaaagtcttcatcatgctctttaagggcttttgtgtctgctgtcccgtctatttttcataatctttagagcctgcttagaggaattactaaaatgtacttagtcctattaatttcctttacagggttgattttcttaaataggacagacctctttatttgtccccagtataggccactgtctcctctggcctacacgtgttgtagtcttcagtcttattgccagtcttgggttcctaaatattaaatcccatttagagtgctttcttcctgactctagatgtacattctttaggtatcttcagttgtgggatttgaaagggtcctatcctattttgggagattattgtatgacctgacatgaaattactgcaatgctctataaagtagaattaggggttcagtaaatactctgcaagtatttacttgcagacatggggagagatgggaatgtgatggtaagcacaacaaaaatctctatcatcaggaaggatattgcctcttaaaatactattttaattttagtgattttaaataataattttaactacattactttaaataactttttttctggattaaattactttttaggttgctataagagaaaattaaagagagaaattagggaacatgacagaagggcctttctagtctcacaagagaagggatagtcagggataattttatgggagaagtgacatttcaagtgacacttgagggatcactagaagtctgtttgatgacagagagaacagtaggagtgtgagctttccaggcagagagaatagcatgtgcaaagtctccaaagtggaagtaggttggtatattcaagggatttaaggacagttaaggtggctgcaacccccaatatggtagaggcgtgatataagaatgaaggtgtgtgtatggaccagctcatagtccataaaggctttgtagcaaaattttgggtaacgatacatgaatttaaaacttttcactcaagctactgaggtgagaacagatgtggggtgggagctagattaaatgtggagattactgttaggatattattgatgtaaaccaggcaaacatgacattgcttagactagagtaatgatctctgagatgggcataagttaatgaatttgagagatacataggtgataaattcaagagcagtaagaagtgaagggaaagaagatttagggctatgtgctaggtttttggcttgtgccattaactaaaataagaaacaatagaggataaatgtttatgggaattgaatataggctcaattttagataagttgagtttgagtatcaactagccacaatcactggtcctctatttctggtatttgtatagattattcagccactcacttgtgttaacctggtcaattttcctcattttcctcactcagatcactggtatttgctcttttatttggtagtagtttgaatccattttctgtctttgtttctcagccctcctttcaattataatggtagctaccatttattaaatacaactaatataattatctcagtatcagtagctaccatttaaagaaaaaaatttactgtggaaagaaatatgctcaaatcagtaaaaaataatataataaactagcatttacttacctccaagtttcaacatccagcatttttctgttttgtttctactagtttaaaaattctggaatgttttaaaacaaaactcagatagcatattctacctctaatttcggtatatattgctaacaattaagaacataaaaacaaaaccacgtatcttacacaaacatatctcaaacaaaaagaacaataattctttaatatcaggtatcaaatttatggttaatttactttaattatctcaaaagtatttttgtcaagattcaaacaggtatatacactgcattttggttgatctattttatcaatttctattaagttataagtttccttttttaaaaaaaaatgcggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctggacgacagagcgagactccgtctcaaaaaaaaaaaaaaaaaaaaaaaaatgcaatttatttttagaggaaactgagtttttgccctaaggatttctcacatttcggggttaacaacttttatctctatgaatttaacatgctcattatcctgtattttctatcattttatacattttcaataataatatcttgcattttctacaatcagggagttagatctagagattttattatatacaagttgaattttgttattgcttttcttaacaattacttcacaggcattgttaagtaatacttattttgatatactagaggaccatattatctggttttctcagtatttgtttttaaaatttatcagcagcttgaagtgatgtcagactgtcctttcaattacataattctctagcaaacttttatatggttttattttcactgataagtatatcctacatttggtattttattaaaggttgcaagaatggttatccccttttttttgtaaagaataactttcttcatgaactatttagttaccctgtacaagaaaagcggggtaaatgtttgattcttgtccttcatttttcaattttcagaataataatgtggctacctaacaacctctaaacatgatatatttttaactgtagtgaagacttctaaagttttgtgtatttagtgcatttcttttgggagacaaattgatgcatttgtgttcaatattttgctaattagtggatattagtcaacctacattatgatttgtgagtcaatgatcattatgattatatttgtgtgtgcacgtttgaagttcaagaaaaaaatatgtagccatcatctctttatatttgaagtttacactcactcatttgttcaataaatattgaacatctattattcctaacaccttatggtaaatacctggggcataaacaaattgtataagtcactgacccttaatttgatgttatgaagtcagaatctctgatgtaatatccaaggactgccagttattagtctcaggccccatggcaagagaaaaggaggaagagaatcagcatatacttaagatttgttcagtaatttcacttatcacaacctgagtgttctcaactctactagacaggactatttggagtttcaaataatttaatagatattaaacattcaatataaggtctgacacatattaagtacttaataaatgttcaccattttcattaaagaccataaattggtgctgttagtgtttatcactataatgctttcaatacttttaggctatttttggtctagagagctagggaataagtattttattggatataattaaatatcattgttttaaattggtctctccttctcatgttagcaacctcaattgcctttttttctccaattaaaaccttgttccttaggatactgaagttctgcaataacactgagatgtcatacttctgtagaatttagaaattagcacatgttctttctcttaacaaacaatgtttttctcttttattcacttgcataatttctacacatactgtaagatacatctcaggtgtcatagcttcaagaaagcattttctgatctacagaccttctctgaggataagctggaggactatcttgcattttctcattctaccctcaattaacctttgtcattgcactcaccacaatgcataaaatctactgatatttctcatgccctttctatatcatgaatcctttaagagtaaaaatgtgtttcacaccaaatgcctagaacattgcatgttaaaaaatatcttaggagatggagaatggatggatgagtgaattaacagttcaatttcttcttttgttttccttattttgtaaaatacatgttctaaaatatttcaaacatgcagaaaaacataaacaataagcactcatgaattcattacttatttaataaattttaaaattttagactaatggatgcacttttaagatcacatagtatcatttcggacacacgaaaaataaagctagaggaggaaaggtaaaagtatgaatgagactagctcttacattgaatgaagtgtcatgcagggcagaacccatccatacattcagcatagagcagagaagatgagaaggcctaatatgagaagagactcacagaacagaattagggatgaattataccagaatcttggtagaagtctagctagaaggaggagacaagtgtttacctaggatttattcaactgtcattttcattccacattatttattggatgtctactttgagatgggcattttgcatgcatttttttctgattcagtcttcaaaacaagactgtgaggtacatattgtatccctttatagttaaataacctgatgtttatgcttaagattaagcaactactaaactgcagagccatgtctttctgcgtacttccatgtctcacagatattttcattgtgttatcttccatgctaatgttagttttacttgctgattgcatttggactatactaatcctgcttctagttttagacttcatacttttcatgttctatattctcatatctgttctgaatgtcagctttagttacttggctacatttttgataggcttctagaatacagatgtgtctttagccaccctctgctccagtttcaaagtgttctttgtaagtgacacaacctcaatcatgcactaaagctcctcctaaaactgatcctcataggttgttgaagtgttaagaaaattgtggtcgccacaatgttgaatgacttatattttttttttgcttcagttgaactgtctataattattttaatggcagagggtattgatctctgggaagccaatttcctgattacatatattctactacatgcagaactagttttactatcacttaatgcctataccacttgtaattaaaatctattaaaattatttaaatagcattaccaaagagcaaaatatgctttataagaacagcaagaataatctaagacacgttatggagaaaatgggctagcaggaaaatataactgtagagttgaagaatggctgctgagagacagcacaacctcggatgaattcagaacagaactagctgatgaaccaaaatgtagaactaaaatgtacaaccttcacaagtttaaaaaaccaactcattttaatgtcaataaactgtacagatcctctaggagaaagcacatggctttcaatatttattgaatataaataatgacacaaactgtcagtaaagtaattctcttatctcagagctcagaacatgatacccccaaaggatgacttcctggtgtgctgagtattttcagctgaaggagattgggagtgccacagaaacaagaaggtctctctgcccttcccctggcctctttttctcccttgaagtgggtcatagaatccagaactccccaaagcaagccataaaacctgggaaggtcattctctgacctccttccttttccccagaggaccttcatgtgacaggtgggtcgtcagggggagaaggccttgcttgtttagattcttctttaccccaggggcctaattctgagcattacaatctctgtatcatagagataattagacattcaggcacagtaggagttgcttaggcatagacaaaggacaacaggttttgagtagacaatcagaaattgtgaattgtgatagggactcagatttcggaagaagtagtttcaactctcaaaagtttaaaatttctaacaaattagcaaaattaacatacctcctatgatgaaaagaaaataatctcagtgattaagcttcaagtgatatcttttcaaatagatgcaccaaatattgttacgcaagtcagtggttgaaaagcatatttacctaaattatcagtatcatgcttatttctcactcacctttctccaaatacttacataaattgccaaactaagtttgggtttacagagatatttacctgttaaattaagtttagcttaaagctgcctccttacatattttaagttcagcctaaaggtatctccctacaggtaaactgaaacctaactggatgtgtaaacagactgtaatctactcttatgctaaacaccatgttttggccaatcaaaggtggccaactgttcaaaccgtgttcaaataaggcaaatgccaagctataaccaattgagctgtttctgtatctcacttccatttcccatacttcactttccattttctgtggctgtactggagtctctctgagccttctctggctcaggaggctacctgatttacaaattcattctttgctcaataaaactcttaagtataatttgcctaaatttgtcttttaacatacctgatgtcaacttgtgtgcctcccttagagttcagcctgccctgcctatcctcctaagcttatttaatgtggcgcttaacctgatggcctgttgattgctcacaagattaatttgccctgaaacattccttttcatcatctcacactcttatttctgaacaaatttacaaccattatagaaaacatttatttagacacccagtatgaagtaccacatccagagttcagataaaatatgaggcagtgactatttttaaggtgtcagaacaatatgcattacttcccttccttcatttaatcaaacaattgtttatttaatgttaatttttgtgccaagccatgtgcacgacaacagacgataacagtgacagatgagcatggtccttgtcctggagtagttcacagcctggtaaggaagtcagagaaatcaagagacaatttcaggacagtttattaagtgcatattgttcaaaatatggaatgtggtatcagtcagggccctggcaggaaacagctgacgcactgaagctgtttttttgagaagggcttaacaaagagactatttacaattttgggagtagggtttaaggaatcaaacaagtaatcacgcagtacactgggaatgaagggcaagggcaatgaacaattgaactggaacacagagaagatcactgtatcgactgagcctgctggcaggatctgtggccttacagaaggatgcaggcaaccactgtctacatggcaaagagagatttgagaactaaatatcctgaccacagaagtcactttcttctgccctctgatcttctagtcatgcacctctggggatgaagccaagctcaagccagaggagcaagaagcctactgatgcaattcttacaagtcagcctcatggggcccagaacaaggtggagaagggaaaagaataggtccagggggctagaggaataatatctaacacaaatgcctactctatgctttttatataatgttattcatctttacaactaccctgtaggaaatggttattttaattttgcaaatgaagaaaatgaggttcacaaagtttaagcaacttactcgagggcatgcaactagtaactggtggattcagggtttgaactcaccagtgtggctacatctccaggtctgtgtattgagatttacgtgtaggaaatgatgggaccacaagagaaacatgtagcccatactatctgcaaatgggccaagggaggcaagattgctatgaaagacttcctagagagagatgatgcctgaactgagcttgaaagaagattggtgtaagaaaatagagaggaaaaaagggacagaaactgttgcccaggtaaagggggcagccaaatatagagatgacatattcttttaggacttcaagtagctgattatgtttgaaacagagagggcagaagtaatgagaaaatatgatctctatagtagcattgtgaaaaattaacataatttagggacatttagatgagttaaagattgtatggtttatgtctcactgtgtgtacatattaaggttcataggaacaaatgaataggattattttaggtgaaaataagggagatagaaagatttttataacaaagacataatgtgcttgcttattactgaaacccatctttttcaccattggccctcaatttatcacttttgaggtctatgccaacaatttacagaagttttataaaatgtataactgttactgctgcatacaatataatttgtgccattgatgtggctcacagcttcatcataaatcctgcatatgtaaaaatgtcaatcaataatgcaaggctacaaagatattatgaagacttctagaaattctataatagtacatttgttatagtgtggtccccatatcacttacatataaactctactttttttgtcaaacatgcctcttttatcctatggccaaaaatacagccttttatctagggacaatcatgatacatagaaatatcaaggaaacaaacacacacaaaaatggcccttgaaacaaaatagatcatcatacaaaactaaagttttgtcttatataaaccatcaatttcatttgttcctcagtttctctttaagtaaaatagggacagtaaaatcacctcatagcattactgttagaattagataatgtcttcataaaagaaagcttctacttcccagatccccaaatagtctatatacttcacttcatattttatacatctcctttctggaggacatgccattacttgacttaggaaggacagggaaaacaaacagatgtggaatcctatttctttgaagaatgccattggtatttttatgggattggtagtattgacattttaacgatattaattggaatattattctaatccatgacatgggatatctttccagctttttgtgttctcttcaatttctttcgttggtgttttacagttttttttgcagagctcttttaacttcatagattaaatttgtttctaaatattttttatttttgaagttattgttaatgaagttgatatcttgattctttttcagatgttcaccgttgacatatataaattatactgatttttgtatgttgatttggtatatagtcacttttgtgaattagtttataaggtctaacagttttttagtggagtccttaggtttttctaaatctaagatcctgtcatcttcaaacaagagaggttgattaatggattaaaaaaacaggtagaagaaataaaatctagtgttccatagttcagtgtggtgaatagagttaacaataactattatatatgttaaaatagctggaagagaaaaatttgaatgttcccagcataaagataaatgtttggggtgacatatatcccaatttacctgatatgatcattacacattatatgaacctataaaaaggtcacgtgtaccctgaaaacatgtacatctattatatattaaaacaattgaattttaaagatatagaatcaaactatatccagttttcttcttatagtagcatttctaaaaaaagttaggtaatgaatataaaagaatatacagaattttgaattatgaactctttttccatcacccgttgtatcaattaattagtaatctatatttgtgctactaagattctatattatttttattttatatgctaggaaaacaggctgagggattaagaaactttttcttgatcctttgagagtttcatagttgtaactaaattcccaggcctagaattctcaattcatttcgatcccttaatcccctaaggatctcacatttgtaaagtcttttatatcatcagatgaaaattgctactgtacaggaagacatatttatatcatatgatcaatggcactgagaaatagagaaaacatgtttcataccataagaaagcaactctgatgtagtatgaactttttgccttgtgtcagtgtagaagaagctggagagcaggcaaatgccctcacatctcatttattttatgatggaggtctgggtaaagagaaactggggaaaaatccaggtttcaacatctacattcactgtccatctgtccagagaagcaagaactcctacccacatcatgttacatacaacttcagttcctcccaataactataaaaccaacctgcttcccatcttttcctctgtcaagagatgatagtttattataaaataggaatatatgaagcactgatatacttctatgcgttcagatatacttttatgctaactgtatgactcagtttcactttgttgaggtataatgattaaatacaaagctttaaaaaaggctaaagtgtacatagggtgaactaaggaaatcagggctatttcagaatgacacaaagggaggcttttctttgatttcacagcctaggccctacctcaaagttaggctaccttgtcaaagctgttatttaatgcttttgaatttttccatccaagagctggctagcagacttattttcttcataaaagttatacaatcttcttttagcagctacattacgaatgcgtaagagaagctatcagatataagcttatggttattaaactccttggaattcatgtgattctttcttgttctagattataaatataatatatatttacagaaacatgatccagagagaaaactggtccagactctcaccatttaaaataaatttagcttctggaaaaatatttaaataaacattaattattgaaaatcaaataagaaaaaaattattggttctggaaatgaattaaattaaagccagtgcattaatctttcaatctgatgcacttagtttctaggaggttaataatccagatatagactcttcatgttgggatatgagactttaacgcttatcaggagatttggtcctaggcatgtaagaaaaggagagctgaaatagaaaaccttgcataaacttggcaatgtaaaaaggctgctcttacaggaagagttagatgggaaaaacatccaccagaagaggaaagttacagccgcaaatgatataaacttttatagagtcatagaacctgagctcacaatttaagacatggtgaagccccatctctactaaaaatacaaaaagtagctgggcatggtggctcatgcctgtagtcccagctactcgggagatggaggttgacatatatatatatatatatatatatatatatatgtataacacacacacacacacacacacatatatgtgtatatatatatatacacacatatatatgtgtgtatatgtatatatatatacacacatatatatgtgtgtatatatatatatggttttactataatattttagcagtatatacatactgctaaatgatatatatactgctaaaatgtagtaatatattactatattacattataattaaatattatagtaatattatagtaaaaccaaaataaaacacaaatattagaaacctcacagaaaaaacagattattcctccccacccccaaattagacaattaaaaatataataaaggaatatatccaatgtattaagaaaaaatagcatcaaaacatagaatttcagtttaatgtattatgatttaagaatggagttaaataaaggtattttgaggggaaaggctgcgaatatttaccattcacagcttttcaatgagagaatgactaaaccatgtacgtgattgtggaggaaagaattcagaaacaatagtgagcaaaaataactagttaaaaacaacctgtttccccttccctcatctcctagcaacgaatcactctaatttctgtttctgtgagggtttgaatattttaggtaccttataagtggaatcatgcaacatttttctttcagaggctattggctggtttgtttcatttagcataatgtttttcaagttcatccatgttgttgcaattggcaggatttgtttcatttttaagactcagtggtatgccactgtgtatatataccacattttctttatccatgcatgtcaatggacacatcagttgattttatatcttagctattatggatagtgctgcaataaacatgggagtacatgtgtgtctttaagatacaaatttcatttccttcgtatatataggattgttagtagcaggattgctagattgtatggtagttctattttaactttttgaggaacctccatactgttttttcataatggccgtatctttctacattctcaatgtttcagttatgcaatatgaaacagttttaaggatctgctatacaacatagtgcctacagttaataatacagtattatacagttaaacatatattaagagagcatatcttagattaagaatttctaccacaataacaaaacaaacacacacatacacacaaaaggacatcaagaaacttctgaaagtgatggatttttttttttacccccattgtggtgatggtatcctgagtgtatatgaatatctatcatcttaaaattgtatacattaaacatgtgcaagtttttattttatataaataatatctcaaaaaactgtttaaaaagcaatttatagtttcactgtcaggaaaatggtgtgtccaccaggccttcttcaattctatggtttatctatttaaaattccttgaaagaactagaatggttctctttgtagtttccagcattcatctgttttttcctatttttaatttgatgttcatgtccatggaaacctaatagaaaacttcacatttatattaaattttcttgtataaattttaaaaataactagataaaaatgtgagaaatacactgaccataaaaacaagagtgatgacaaataatttcagtggtttaaaaatgatgtgaaactagaatattatacataacacaaaatgactttaagctaaaattgttattaaggattaaaaaaagctgttattacagatggaagaaccaattcatttaccagatagctaaacattttctaaatttgcttatacctatttattgccccaatctagaatacaaacgtgaatataccaaaaggttaaaaggatagggatagaaaaagaaaaccaggaaattattagccgagctaaagctgttataactttgattatcacataaaatagtctttaagccaaaaatattttttaaagataaaatcatttcttgacaagaaaagcaataattctctaccatacaaattaaaggctcttaagattcagtagcattttatttttatacaaaattttaattatagtttctgttgtttgattctaagtatcttacaattttgtaccagaaatatacaattccctaaatatttttgctcctatcaataaagctacaaaattggacattgatatagaagtatccttaactgtaacacaaaattttaatgaatctctcagaaagtgatacatcaaactttatttagtaaaatatgaaatgttttaataaacagccatcaacctagccaaaaactaaatattaaaaaatactgaataagcaaaattatccagatgtgttttctggccgtatcgtaataaaaatataaattaattgcaaaaagccaaaaaccacaaatgacatatttgtaaatgtataaattatagaagaagtaaaaatatatctcaccttatatttatttatttattttattatactttaagttctagagtacatgttcacaacgtgcagttttgttacatatgtaagacttggaaccaacccaaatgtccatcaatgatagactggattaagaaaacgtggtacatacacaccatggaatactatgcagccataaaaaggatgatttcatgtcctttgtagggacatggatgaagctggaaaccatcattctcagcaaactattgcaaggacaataaaccaaacaccgcatgttttcactcataggtgggaattgaacaatgagaacacttggacacagggtggggaacatcacacatcagggcctgttatggggtgtgggagagcggggagggatagcattaggagatatacctaatgtaaatgaccatatatttataattgaaaaatataagctttatatatcagaacttggaagatgaagaaaaaaatggctttttgataggaactcatacctcaaataacatatattacaatagaggtaaaactgtaaaatttatttttttaaatgttaaatacaaaatgttagagaaaaaagaaaaatagaacaaaataaaaaataaatgtaagattagtaatttttaaaatattttaaagagaatatatttttgagaactaataaaataggtttctgagaaatttaatcaagaaaaccaagagaaagcacaaattaactcttaacttgtaaaagcattataactatagatgcagtggtcattaaataaaatcataattcgaccaaaaattttatgaataaaattataaatctgggataaaatgtatatatttaagggaaaatacaattcacaatgttgacttataagaaatagaaaatctaagtaaaccaaaattactaaggaaatttagtcagtattaaaatgtctatttgaaaaagtaacatttcctgatggttttacaattgtgttttgtcaaaatacctaggaacatatatcctctatattaatcttttatggacaataaaaatggaagacatctctgtaactaattatatgaatccagtttactttattgcaaaaccaaatcaagacaacaagataaaagaaaaccataggggactgtcactaatggacatgatgcagaaatctcaataaaattttagcaaacaaaactggcaaagaaattaaaaacctacatgaccaactaagattcatctgtcactcttctagttatgatataaaattggaaaattcattaatagattttggttaaaccacttaatgttactttctgctaaagttaaacaaaaacacatgataaaggtgattcttaaatgaataaactcacaaggacatgcctaaaaggaggaggagatcatacccgtctgggaaggtgggatgaaaagagtgaataataatggtagccgtactgatcaagctgaaccctacactggaagagtggacagcaacaaagctatgcaacgtgcactgcagaaattctgaaaggctcaggaattgaacaatgtacctctggaatgggtgtggagggaaaaccaaaaacaatgttcttattttaaagtctttttaagatgcagtttgcttccggatcaaacatcccagtttctgcaaaggtagaggttgtctccattgcaataaattgccgtcagaagcacagacatattctctaaggaggacctctgcagtttctgcattgaaagacacaagacacagtgtaaggctttgaaaacagaggaactggaaaaccctccattgacagttgagctgccaaacctcaatcttcatcctcaacttagttcctagatttccggaagctgttatttatttatttatttatttatttatttattttcctgttagggaagagattggaagttttttttctgagaagtctgaccagccctagaaaacaagtaactatacaaattacgagtgggggttcccagtgaaatcacttcttcagacctctccttgattaagcttgtagattacggtctacaagactcttccaggtgtccacatttaccaataaactttatagtgattcaagtttaagtatgagcaaacatcacccaattcctgaagaaatttccaacactaaaaaaaaaaaaaaaagatgtgccagaaactgtaaaccctagctgatacaaacaataatatatttggacagaaactcttaagtcagaagctttctccatcaaaatctaaagagcaatatccactgacttcagacatttggttctacagggaaatatgaggccaacctcatttttatttatttatagataacttattttatctgtttggattcttataattcttcttctctttataggaaggatacaaatttcataaagatgttgcaggggagaggaggggccaagatgtccaattagaagcagctgcggtctgccgcactcttggagaggaacgaaaggggcgagtgaataacaaaacatattttttaaaagtattatttatcttttctaaaaaatatttttgatacataaaaaattataatgaagctatataataattttgagattgttaggttgaaatgtgattttgtcttttagtgaattaactatttgtatttcctttattcttttttatggaattatatatttatatcctctgatcccattgctttagagaaattaatatttttaacagtaattaattatatatatcaatttacttactttgcttttattaatacagggttattttctaaactagggccaataaaattcacatatacttgcttttgactttttgttatttgttaatgttttgttatttgttatttgactttttgttatttattatttgttgtttgttatacttgcttttgactttctgttatttgttatttgttatttgtatattgttaacttgcttttgactttttgttatttgtaatttgttatttgttaattcaaataacaaaaagtcaaaagcaagtatatgtgaattttgttggccctagtttagaaaataaccctgtattaataaaagcaaagtaagtaaattgatatatacaattaattactattaaaaatattaatttctctaaagcaatggggtcagaggatataaatatataattccataaaaaagaaaagaagaaataaaggaaatataatgtcactaaaagacaaaatcacattttcaaccaaactaataatgtcaaaattattatgtagcttcattataattttttatgtatcaaaaatattttttagaaaagataaataatacttttaaaaaagatgtttatgagacggttgtgaatcaagctgtcttaaatactgcctggggaaagatataatttgtctgaacttactgaaaacaatctgtcaattagtatgacaattagtatgtcaaacaaatactgttaaagtctctgtaaaggtattagtcatttttagaaatatgttctaggaaaataagagatgaaacttattttaaatttttggtgatttcctgagacatgatgatgaggctattctggtgaccacacttttaggaatcactgctttagagaaactttgtatttctacctaaagacaggtacaagcttctttactacaatattgtttgttgcagatgtaaaaattgtaattaaaaataaaataccaaccataaaaagatgggtactaggttggagtataattataaaatataactcagctgttaagaagaatggactaggtcctgaaacaacgttgtgggatcttgaaagtgcactgtgaaataagcaagtttcagagggatacatatagtatgctatttatttagctttaaaaagcttaagatactgtatatgatttacaggtacacagcagcaaatgtaaaataaaatgactgaaagataagaataaaattcatggcaattttgccccagagaaggatttcacatcaagactggaaatggaggcaaaggtacttaaactttatccgtaaatacttcctattataaaataggatttgaagcaaatatataaaatgagcattttcaagacttggtgttgggaataggacattaatttatcattacaagtaatatttagcatccatctactatttagcatccaggggcttttttaatttttttggcgtggagcatctctgatggagcatagccataagtgcccatcccccaggactcttcatgtctttctgagacactctagccccaactgactgccagtttggagatttctcaaagaactttaaacagagctaccattcaacctagcaatcccattactaggtatgtaccccaaagaaaataaattgttctaccaaaaagacacttatatgtttattgcagcactattcacagcagcaaaaacatggaaccaaccacctaggtgcctatcagtggtggactggataaagaaatgtggtatatactacatagccataaaaaggaataaaatcatgtcctttgcagcaacatggatgtagctggaggccataatccgaaacaaactaatgtaaaaacagaaaaccaagcactgtatgttatcacttttacatgggagctaaacactgagtacacatggacataaagatgagaacaatagacactacaggcctactggggggaagtagaagagtggagcatagattgaaaaactacctattgggtactgtactcactacctgggtgacaagatctgtaccacaaacctcagcattataccgtattcccatgtaacaaacctgcatatatatgtgtacatatatgtatatatgtgtatatattgtatatatatgtgtatatatatctgtgtgtgtgtatatatatgtatatatgtgtatatatgtatatatatgtgtatatatatctgtgtgtgtgtatatgtatatatgtatatatgtgtatatatgtatatacgtatatatatacgtatatatgtatatacgtatatattacgtatatatgtatatacgtatatatatgtgtatatatacgtgtatatatgtgtatatatacgtatacacgtgtatatgtatatatacatatacacgtgtatatgtatatatacatatacacgtgtatatgtatatatacatatacacgtgtatatgtatatatacacatatatacgtatatatgtgtatatacatatacacgtatatatgtgtgtatatatatatattttatatacatataatatatatattttatatacatataatatatatattttatatacatataatatatatattatatatataatatatataaaatatatatattttatatatattatatatattttatatatatatttcatatatatatttcatataaaatatatatatatatttaccctgtctctaaactaaaagttgaaatttttttttttaatgaaaactcatcagtgtaccactggtaaaagagggaggggaaagaggagagggggatggtgtggtggttaataccaagtgtcaacttgattggattgaaggatgcaatatggatcctgggtgtgtctgtgagggtgttgccaaaggagattaacatttgagtcagtggacagggaaaggcagacccaccctttacaggtgggcaccatctaatcagctgccagtgactataaagcaggcataaaaacttgaagctaggagacaatgggcctagcctcccagcctacctctttctcctgtgctggatgcttcctacgctctaacattgcactccaagttcttccgttttgggactctgactgcctctccttattcatcagcttgcagacagcctatggtaggaccttgtgattgcataagttagtacttaataaattctttctttttttcttttctttttctttcctttctttttctctttctttccttctttctttctttttccttctttccttctttcctttcttccttccaccctccctcccttccttccttccttccaccctccctccctccctcccattcatccatccatccatccatttatccattctattagttctgtccttctaagagaaccctgactaatacagatggggagggagaaagggaaaaaaagagaaagcgagattgagaacagtgcaacacccaaaatctccttctatgcctcttaccagtcatttattactaaccttagaacaggtaaccactatccaaacaccatcaattcatttcggcagtttctgatgtggtagctctagttcattcattttcatgatgcatagtaatcaaagacacacacatacacacacacacatacacacacacacacacagttttttcattctgctcttgcggcttttatgttcattgttcatctgaggagaagaaccttttctagttttttaccaccgtgaatagtgctgtgataaacatgatttttgtgaacaaaaggggcacatttctgttgggactatacctgggatttacattgctgcagcatactgtttacatgtttcagtcccacttactactacttttttttttttaatttaagttttagggtacatgtgcacaatgtgcaggttagttacatatgtatacatgtgccatgttggtgtgctgcacccattaactcgtcatttaacattaggtatatctcctaatgctatccctcccccctgcccccaccccacaacaggccccagtgtgtgatgttccctttcctgtgtccatgtgttctcattgttcaattcccacctgtgaatgagaacatgcggtgtttggtattttgtccttgagatagtttgctgagaatgatggtttccagcttcatccatgtccccacaaaggacatgaactcatcattttttatggctgcatagtattccatggtgtatatgtgccatattttcttaatccagtctatcgttgttggacatttgggttggttccaagtctttgctattgtgaatagtgctgcaataaacatacgtgcgcatgtgtctttctagaagcatgatttataatcctttgggtatataaccagtaatgggatggctgggtcaaatggtatttctagttctagatccctgaggaatcgccacactgacttccacaatggttgaactagtttacagtcccaccaacagtgtaaaagtgttcctgtttctccacatcctctccagcacctgttgtttcctgactttttaatgatcaccattctaactggtgtgagatggtatctcattgtggttttgatttgcattgctctgatggccagtgatgatgagcatgttttcatgtgtctgttgctgcataaatgtcttcttttgagaagtgtctgttcatatcctttgcccacttgttgatggggttgtttgtttttttcttgtgaacctgagttcattgtagattctggatattagccctttgtcagatgagtcaattgcaacaattttctcccattctgtaggttgcctgttcactctgatcgtagtttcttttgccgtgcagaagctctttagtttaattagatccatttgtcaattttgacttttgttgccattgcttttggtgttttagacatgaagtccttgcccatgcctatgtcctgaataatgccgcatatctacaaccatctgatctttgacaaacgtgacaaaaacaagaaatggggaaaggattccctatttaataaatggtgctgggaaaactggctagccatatgtagaaagttgaaactggatcccttccttacaccttatacaaaaattaattcaagatggattaaagacttaaatgttagacctaaaaccataaaaaccctagaggaaaacctaggcaatatcacccagttactacttctaccagcagaatatgagactcccaatagctttacattttgacttacactggaattattaatattattaatttaagccatgctggtgggtatatagtggtatctcattgtgattttaatttgcttccttctgatggatgaaattgagcactattttacatttattgataattatgacatcttctcttaaaaagtagataggcaaatcatttccttttttttttccttatttggtttgtagctattctttgtatatcttaaatgtgttatttgtcagatacatgtgtaagaaatatagtctcctatccttctacttgtcctttttactctcataggaataatttgttgaccagataactttaatgtattacaatatattgctcattttctttattagtagtacagtttgtgaccctttaatagattgttgcttaactcaagacaatactaatattctcctgtatcatcatctagaagctttgctgttttacatttcactttgaaatttaaaatccacttggaattgtagtaaagtaggaatcaaagtctattttctctcatatagttatatagttggacccatataattcatttaaaatgtcctcttttcttttaatcatttgcagtttatctttatcaaatatcaagtgaccgtcccagtgaatctttttctggactttttagtaagtgctagggatctatttagcttttcttgcaccaatgtcacactgtcataattaaagtgtctttttagtaagtttagcaagtaaagtgtctttttagtaagtttagatatcaacaagaattaaaattttttttcttcacatatgtcctggctgttctttgggctttatattctcatataaattttggaataattttgacattttctataagaaaagcagctgggatgctttcctggggattatttcaaatctagagaacatttgtaaattgataaatttacaattctaagtgtttctatctatacacaggacacattcattgaaatactcaatcttagttatctcaatcatatgttgtagttttgtgtgtatggagctttgatttattctgtaagtatatgtggcctttttacactaatgtaagtgtattattaaaaatagtttgctctatagtcttaagttgtgtgtccccctaaaattagtatgttgaaacataatcaccaatgcaatagtattaagagtagggtcctttggggagtgattaaatcattaggtctctgtcttcatgaacgagattagtgcctttatatttttatttttttatttttttttgagacggagtcttgctctgtctcccaggctggagtgcagtggcgtgatcttggctcactgcaagctctgcctcttgggttcacaccattctcctgcctcagcctccctagtgcctttatttttttaaaaaaatatatatccttgtaaatgagagcaatcttgccccttcaccatgtgaggactcaggaacaggccctcaccagacaccaagtttggtagtgccttctccttagacttcccagtctccagaattgtgagaaataaatttctaattttttaaataaattacctagtctcaggtatttagttatagcagcctgaatagacgatgacaacatattattttaatattgatcttatatccactgatattggtaaattcagttattgtaattgtttatatgtgtacttttttgtagttttctaaataatggtttttctatgaataatgacgtttacactacttctcatacaatttttatatttctttttatttaatgtgctggcaaagactttatgcagaatgcaacctataagcattcaaaatgggtctccttcacaggggaaaagtttttactgtatcaccgttaattatgttcttcaatttgattagacagtcttcatcagattggagacatttccttctcattctagtttgttaagaggttttgggtttcttttcttaaaatgaatgcagttgttacccattttatcaaaatacctttctgcttctattgacttgaatgtttttctcttttttctattattgtgataaatgacatagtttactttttaaagtacagattattgggaggccaaggtggacaaatcacctgaggtcaggagttcaagaccagcctgaccaacatggagataccccatctctactaaaaatacaaaaattagccaggaatggtggcacatgcctgtaatcccagctactcaggaggctgaggcaggagaatcacttgaacccaggaggcaaaggttgcagtgagccaagattgcgccattgcactccagcctgggcaacaagagtgaaactccttctcaaaaataaataaataaataaataaataaataaataaagattacttacatacaaaaaaatttacgttttaaaggtatgtaatttgctgaatttttaaaaacattcacagccatgtaatcatcactataaacaagattatttttattactgctggaagttccctcatccctttgtagttgagtacgctccgtcaccccactaacctttaggaatggctgcttctttcattatagtttgtcttttccagaatgccatataattgaatcgtataataattatacattaatccattcaaacctggcttttccacataatatattttcaagatccatttatgttatgtcatgtatcagcaactccttatgatgtagaaaaattcttttttactggttgatgaatatggggttgttattttctgattattgtgaataaaattgctataaacattgaggtacaggtctttgtgtggacacaaatttttattactcttggataaaacaagattggggttgctgggccatatgttaagtatttgattaaactggttaaactactaacctgttttcaaaactggctgcgtgactttccattccaaccagaagtatatgagatctttacaactagacaatctattctgttccatggaaatctatatctatgctatgcccatgccacactgctttaattgctcttttcaaatgatgccatgaagtcatataagttctccatatttattcgtattttgaaattattttgactatttgaggtcctttgttttcccacatagtttttaaattgccattttctaaaaagtctaatgtagttttgattaaaattatgttgtatctatagatagattttgtgggaattgatatatcacctatattgggacttacaatttgtgaacatggcgcattgttcatcatcactataaacaaacaaacaaaacaaaaatttttgtttttgatttctcccttcaatgtcttatagttttcagcacaaaaattttgtacgtgtttctgtacatattttgttagatttatccataaggattttatgcattttaatactattttgcaaatgatatttttattatccaggtaatttttgtatgtttactttgtattctttttttttttttttttttaagatggagtctcactctgttgcccaggtggaactgcagtagcataatcttggctcactgaaatctctgcctcttgggttcaagcaattctcttgcctcagcctcccaagtagctgggattacaggcacctaccaccatggctggctaatttttgtgtttttagtagagacaggatttcagcatgttggccaggctggtcttgagctcctgaccccaagtgatccgcccaccttggcctcccaatgtgttgggactagaggtgtgagccactgcttccagacaaatttttaattaatatttataatttttgtggttctttggaatttctggtatgttgtatcacgtcatctggtaaaaaaagagaaattttatgacttcctttccaaccgtatgtctttactctctctgctgtactggctataatacctggcacaatcttgaatatgagtggtgagagaagaaatcattgtcttgtccttgatattaggggcaaaacattccacctttgaaaattaattatgatgatagttataggatttttgtagatacaattgatcattttttggaagttttcttctattcattgttttttaacagtttttctttccttattgtggttatcataaatggatgttaatttttgtgaaatatttaattctgcactgagataatcatatgatttgtccttttcagtcaatgagtgtggtgaattataatgtttaatttttaaattgttttcagaccatatattcctgggataaattccactttatgatgaggtattatactttttgtatgttgctgtatctgatatgtttatgtttgttagaaatttttgcatccctgtgatctaaatatgatcatatgctttatagtctcaatattttaaaataagataaagagagaatccccggctaaattttggctcagaatctggtatatgattctgagccattctggtatatgattgtggtataagccataactttactttaacaatattaataaaatacatgtattatcaatttagagtttaaaattttttcataagcattattttataatatcattacaagaatcctgcagaaaaaaataattttcttcattttttagataaagcaactgaaatgggggaagataaaatgccttgcccaatttctcacaatttattaagttcattattagcacttagaggtctgcactttaatatagctattatcctgaaatataaaatttctacctccagatcaattttctgatacctccttgcaaacagcttgacttttaagctccactagatattgtgatgtagatggttatttttgtgctcctactcaccctgttctgtaccctcctttttgtcacttcttatctctggtcctgcaactctagctgtttacggtctgcataatctgcataccaagtcctccacacataccccaacacatctcaatcagcacaactgttaggctttcattcacagcatcatgaagaattatattttattgaatctgagataccattaattattagatgtactgattataaatcgaaccattaatttatgtactgttaagagagaaagatgttattgcaaatgacactgaaatatcttcttaccacattcattgtaattccactagtagaaaattcaaaatatgaaaaggctgtttcaattatctattactgtataacaacccacccgcaactgagtgtcttaatacaaaaaaatatatatatctttcatggttctataggttgacttggctaaaccaagccattctttcttgagttttcttaagcatgttttttcattgatagaagtgatagcaggaattggaggacaccaggataggcatcccatagatggcaattgatgctaccagtgaaggggagcttagctggagctgttgaagagattgctacacaagacattgctatatgtataggcttcatacaacatgaaaacttgagttcagagagggagcttccaaagcatgttctaagaaagaggaagtagaagttctcagtataatgaagggctggacctgtaaccagcatagcattttttcatgtaacatcttttaatcaaagaagttacagggtctcctgattcaagtgaatagagaaacagactgcattttgatggaagtctgacaagtgcaaatatgttaagaatagaaatatgcctctgtgagttcacaaaaaattgaagtatacatattaacgttgttacttgtgattgcctctggttctagagtattgaaagagctaaaattctttgtaggattaaaatttaaaggttggaattgaaacagatttttactttttacagttttctccatatttttgagtacattttaaagggtattaaagaagtatattttgaatcaaaattgactaactgccctctcccaattttaccaaggctcctcaaaggataacaaaagggaataactactattggcataatttatctggacattcctcaattctttctgtttttctaaaaaaaattcctttagaacaccactgctgtattttcttcttcactcctacacaggaaaaaactcttgtaataagaggttgcttctctaaattatagtcctcaaatttttggtaaaggaataattcttgcaaagataaaggaaggcaatgggacaagttaggtttaaacattttttaatcttttgtattatgtgggatgatgagaagaggcacgaactgtgggatactggttgtagtattttgctatttcaacgttaactcttaaacagtgaaatctctccttacaaagcaaggtcatgcatcagtaaaagttcctaagatctgccagacaaatggcttccacttctttctgtattttattttcacataagaataccttgatccctcaaaaggccacatccattaaaaagggaagggatggtgtgggtaactataacaggaacactattgattcctaattagtggaaaacatagtgatgattatttctgtgtggacactataggcatcaataactactattaaatttacttgaactcctcatcacatttttagtaaaaccccatggggtgaagaacagtaaattgcaattgagacttttgcagacttcaaaatgaagtctctgagagtttgaatattgacatgctccaaatctgtcattgaggactttgtaattactccatctatgggagtaatttcatctaaatgctctctccttgggccacactaccttttgaacttctattcaaacatgctataacagtagacactggacaaataagaaatggattttgcaatgtttacatttaacttctttcttgatttcctctgtgtccataaaacttcaggagtgccacttatctttttatagatcagattgacactgagtaaggtatacctagggtttgagtctgaatctgttatgacaggcaataaatcacctaaaacatctctttgtatttgttgagcagtcaaaatcacttataggaagctgatgacagagattatttatttccctcggttggcccaagttttcacactcacatcaattttagagttgttactagactaatgacccaattcagtcagaagcttatgatatttttttgtcatccgttttgtgatcatgaagaggatgaaatgttaatagttctgacatttgttttttcatatcttttaatacactgctaaagaaaaaattctcactaatattatagagacttcttttacactgttttctattcaaaataagtgagaaattcagtaacattttttaataacatttttctcctaaattcccagaatgtcaccactaggaaaaagacatcttaggtaaatataagacaaatttgttaaacttcaactggaccttcggtacttctattgagttttttccacagtagatgctagacacctatctcacatgctttcttcttcttggcagataatctggtgtattagttaaggttcttcagagaaagagaaccaatatgatgtatatgtatgtgtttttatacacagatctgtatatatgtgtacctgtatgtacatatgcgtgtgtgtgtgtgtgtgtgtgtgtgtgtgtgtgtctgtgtttatacagagagagagaaagagattttttttttcactttaagaaattggctcacatgactgcggaggcttggctcatccaaaatctcttaagagtaggccagaaggctgaagactcagaaattagtcacagttaaagtccaaaggcagtctactggttgaattccttcttgctctggtagaattctagatcagtctttgttctactaaggccttcaactgattgtatgagattatgtagggtaaactgcatatttaaaatttaccaatttaaatgttaatctcatctcaaaagcagcttaacagaaacattcaggataatgtttgacaaaatatatggacaccatgggccaggcaaattaacatattaaattagccatcatacttggtgtcttacttttctaaaacctttctgctgcttcagaaggagactttctacccttcagaagctaatactctctctacccttacccttattttttgatttctcttataacttgttctttcatctgtactcccaaaccccacctccatccccttatgacaccctacttcagtcctttcagtcttcccagaaactcgtcaggtctctccattgataaactttctcttgaccttttcagggttgctgttccttgccctcatttcacagcccaactccccatgtcccatacttccattcagcataggagacacaactctcacaggtcagcagtaggttcctagtagctagaacaatgagtttttctttgttctcgttctttgacatttctctgtaccccggtcctgttatcttcctcttccccattgaatatctccccattttggttttctgtggttttgtcatcctctaatcattttatctatttctccttcacttgcttttcttctgcctgtcatcccttatgtagatgtttctcaagttctattctctgtcttttcctttaatttctttattttttctgcctggataaatatctaaattttaatagttttaaatatgtactttaaaaaaaaaacacgattctaaatgtatgccttctaaattatttcattctcctgtattttagcttcctgaactaaaaatctgggagctatatgtaaaaattttcattttgtcatttttctcacttataccaataagcattctaagcattccagcaagatcctaacaaagaaatacttcttctacttgagtcatttccttcatccttagtgcccagccataatttgaagcttcataatcacttctctggttatttggtaagtcctgctgaccattcccacctctagtctctcttttttgcatctatttctgtaatttgctggagccttctttctaaatatgtgcctaaacatgtctctccttggtctgtagtgatttttgttatgtctcttcaaaatgtgctccatccaacataatatctatttctctttcaatttattattgccacgtgataaaccaatgcatacttagtcatttcttaaattagaaaaatgaaacttgaaagacatgagtctgtagttgctctaatatctgaagatagccctgcaaatatgattatagtcctgattttaattttttgcttatcatgctgttatactaattcaaactaagacagcttctaaataaataaataaacaaataaacaaatgccattggcatctgtcatgagaaatgagtgcctattgagtaaaggcagtgataattcaaagcagtagttgtcaacctggctagattattaaaatccccaagggagtttaaaaaacgctgttgcataggcaacaccagaatctctggaggtgggaatcttacactagagtttttttgttttttaaaagatccctagttgagtctaatcaaaagcaaatttgagaaccagcagtttcccttgctatttgaagtgtacatatttgaaagtggtccataggatgttataaacacatatgtttttttaaaatcaaattacttaaagcataacagaggtgtttaattctttacctatgcgaatgtatgaatttctcttaggaggaagtatagtattcagaattggcaaactaacttattgcagaacagtatctttgtttccctcccagcttttttgtagtatgattgacaaataaaaattacatgcattcacggtgtacaaactgatgttttgagatgcatatacattgtgaaataattaccacaatacagataattaacatattcattatctcacatagttaccgtttgtgtgtatgtggtgagaatacctagatctactctcagcaaattacaaacatacaacacattattattagctctagtaatcatgatgtacattaggtccatgaaatttatttatctttaaatgaaactttgtgtcctttaactaatatgccccctttttcctcaccgccccccactcagccactaataattaccaatctactctccgttactatgagtttgacttctttataaattccacatataagtgagagtatgcaatgttcttctttctgtctggcttattttacttaaaatggtgtcctccaggttcctccatgttgtcacaaaaatagaatttccttttttcaagctgaataatattcaattgaataatatataccatactttatccgttcagttgtagatgggcttttgtcaataatgctgctatgaacattatagtgcaaatatctctttgatacagttattttagtcccatggctatgaactcagaattgggattgctaaaccatatggtagttctaattttagttttttgaggaaaccccatactgttttccattatggctctaaacaatttacattctcaccaacagtgttaaagaattcccctttctccacattcaccaacacttgtctttcattttaaaaaataatagccatcataataggtgtgaagtaatagctcattgctgttttgatatgcattttcttgatgattagtgatgttgaacatttttatatatacctgttggtcatttatatgtcttctttgaaaaaatcttatcaggttctttgcctattttaaaattgtgtttattattattcttgatattgagttgcatgtgttcttaatattttgaatattggctttttatcagatatatgacttgcacttttttctcccattcttttgattgcctttttgttttgttgattgtttccttggctgtgcaaagacttttagtttgctgtaattccacttattcattttggtgtttgtcccctgtacatttggtgtaaaattgaaaaaagcattgccaagactcatgttaaggagcttttccttatgttttcttttagaaactttattgtttcagttcttacttttaagtctttaatttattatgagttgattttgtgtgagatgtattataagggtccagtttcattctttttcatttcaaggtataatttattgaagaggctattctttccttattgtgtattcttagcacctttgtcaaaaattagttgactatatatatgtgggtttatttctgggtactggtttgtttttcaaagaattccttgggactaaaatgctccccagaacactttggtaaatattgatgtaacaatttttctcataggagcactgttggcattttgaatgggattgttatgatgctagttattgctaaggaccttccctacatgtttcaggaaggttagcatttctgaaccccgtttagtaaaatgcagcagcactccccagtgatttcagtaatcaaacacactcccataaattacctagcactttcaagtcagtgatgccatccaaggttgagaactattttgtagctggtcactaggcacaaagaacaggatgattaagtttgtcaattgggaatgttattcactgcaactctctgagtctagatcttccccattgtctttggcctattacataaagccttgaactctgctggtatcatagctagatttgtcaaagactcattcagagcattaccaaaagctacagaggcccaaagttgtcagagaggttctgtctcgtgaaaatataaaacctcatacctcatggggaccattgtaccagtgatgtagatgagattgcctgggccagaaagactttgtgatcacctcaactttagtttttctttctcacatttgaaatggccaccaaagatattttttcttaaatcactcatcatattctgtcattcctctactgaacattcctttattggttttccattgctgaagattaagatataaattcttagtatgacatttaaaataaccacatcataataacaagtagccttctttacatacctcggcacactcacaggcatacaccacctctccatttctccttctctatcaattccagtcacacgaccattttctgactgaatctcgttatttgctaaacaagacatatagtttatatccctaggtttttgctcttattacctagaatggtctttttcatttgacaacctgatgaaaatcctacttaatttttatagcttcttacaattgttacctcctctgcataaagttctccaacatttctatttttcagtcacttttctgttcatggctgcagacactgttatacaacctgtcatagaaatccacgttaaaatctgcaaagtgctgtgtatggtggacgaaatctttttccttttcctacattcctatctgggctctcagaggagagcatttctctagaccgtgtgtcctctggcatcatgctaagaaggcagtttccatcttctaggaatctttattgtccctgctcataagataaagagtagttaatataatttgtgaaacacggatgtagagtgagcaacattggaaatatactttaccattctccttgctctgaccacctcatagatgagtaggaagatcaatgtaaggactcttctctgttttctgcttccatgtggtacgaacacttgggtcaaagtcctacagttgctttctaaaggcaggccgaatatcctcaattacccacccctcatctccctctctgtctctctttttacctgtctctatcccttcatctgttctgtgtttctctttgtctcctttctcttttcctatctttggatgggttttctgtcagtttctctcattgtcttcctctctccttttcctgtaagtaactggtaaatgtggaagatctgaattatttgtacctggcaaattcagctccttccttaggttgagtgttccagactataaacatgggtgaatatataaggatcctgtttgatgtctatctaaaccacattcttaaatccacttttaccatgaacactgtgtgctttggggttagtaggcatatgctttgctgattaaaaggttttcactttgtttttattttcttgtttctagttttcccatcaaatagaaccagtaggacaccctccctcctacctgatctccagcatatttggtgtattggagggaggtggttgcagagtattgggaaaaaggtggtagcagccattttgtggttatattgattcagattcttctaaaaatgcagaataaatgagaaagtttgagtcttccagagggcaactattacaaaggaaaccagattccatttaaataagactctttttggattggaccaaaaaaattaaatattgatgggagaaatacaccgtggggaggaaggaggcctcagtaagacttggtgtctagatgtgacatatttgcgaatgtttaagttttgaaagaatataagtgcatttcagattctttacatgcctttgtttttttctaattcccatttttccaaaataccatccagatgtctttgctatggttttttttttaaaatgacgatctaaactcttttaagtcctagtttctgaaaacaaaatcctgcttagcataattttttaaagtactataattatttttgcattttttacagagaagaagcatgtgtagttgaagagataatttgtgatatccatctaaagatgctgaaggagtcagagttgtgcagagaaactcggatattatttgagagaaattctttgggtggagactgagcatactaagatattaaatagttaaaaacgtctgatttgaatgtcttttgactatagtcagtcatttaattttttcagacttaaattttcttattgagaggtttgatttttttccctatgtactttttatattgcaaaagttatattattttaaatactattttttttttttatggatttgggttggggggtggtctcacttttttgcccaggctagtctctaactcctggcttcaagcaatcctcccgcttcagcctcccagtgtgctagaattataggcatgagccactgcacctggccctggaatactttcattccacttcatagtgttggttgtcctatatcctctgaccagacacactggactacatgacaaggaaaatttaagacaaaaaataaaataatatataactaaaatccctttattgtccattttagactcatcttattataaacactgaaccactcatgcctcatcctaggataacacaaaggcttactggtagtagagattaggggacaacatgataaagggaacttcagaacaaccatgatttgttgttggtcttttcgtcaatgtatgtgtacacacacacacacacacacacacacacatcctggttgaccataggtgttgtcattgtctgttgggataaaagaacaatatttgaggaatgttgaaggtaaacttttgtctaatagtttcactttagcttgtctgaagaaatacttaaggaaatttctgtaatatcttcctatcccacctttccccttacttttccttttagcaataagaacaaataattggactggtgagaacttgtcaataggccatgtttctcctactggtgggtgtgctgtattcagaaagtcactgctcatgtaagacatagtctcttgtttgaattatgttatattcactctccagtgggtacacatattatcttatcttctccaatatacattgcatccatgcagttaacacaccatcagaaaaagatagatcaattccctgacctgccataatgtaacctgtcattccctctcagaatttcacttggcattcttgagctgtccactttgcaggcaatttggtgcatgagcaggtgcctggcaaagtagatgaaacttgtgatatcaaactgtggtccccatcagtatgcttcaaggtttagattcaaggagagagtaagatggtccattgtaataccaatttaaatccatactctctaattcatcattccagaaatcctaaatttagggataattgaacattttcttagctgttagtaaatgtattctttgatctctctttagactgcatttgtgtttattgtctccattatttggaaactagatgagaagatgattgaggacagtctcttgctgttctgtctgtctgtaatgattatgtcccagatattactcattctgtcctttattcagatgtccattattcagaatatctgtatctgacaatcccctctcaatttatatgattatttctctctggctccttcttttgttctaatttttctcatagcaccaatcatactacctaaaattgtattttatatttatttgattattatgtcttcctttttaaaatatgaatttcaggaattcagaatcttgtatttatagctgtatccacaaagcctagacaaaagcatgacacatagaaaacaccatatacatattaaccgaatgatcaaaaaaaaaccttttgattatgtatctgtgtgatacatcatcaatacttaatattttgaatttaagtgcaaaatgctaatgctctcattcatttcagggaaatttatttaacaaaatttgtggtttaaaaataattctaattattgagtttttttttttttttccacgcatctgatataaggagagctactgactcatttaacatgttttaacctatactttgtaatggtgtgctaaatcagaaaaccagatgtggtccctactctcataaattttacagtctagcaaaatagatagctcaaataactgtactataaaatcaacttatgttttcttagtgtgattctatgtaggtgtgattctatgtagattaaaaaaattttgatcactcaccaaattatacaattgataatatttttttaaattcaaggacaaaaataaatagcaaatattatattctgcatacttgagagagatgatccttgtcattttcctttaaatatagaatgattttcagtctaacttatttaaatgttatcagaatgttttctgaggcagagaagaatcatattactaaaatatgttaaatctatacacccttttgttcaagaaacaaacattttcagagaattacattaccctcattgttaattatattgagtatgttaacaataatgggactagagaatttagtatgattacatgtctatctttccacctgttcagtctcacatgtggtggctagtgacaaaccttagacatagtcaaaataaactttgaaagtccctaagaaaggtatattcaaggagatgattatcttgtatctcaaccccaacaaaactagtactttccaaatattagatgtctcttttgtgagcaatgaatgatgtagttagtttatgttcagggttgtgcagcagatttaaatttcattatattacgcttgcattatcaacgtcattatctggtctttgaaaaatggtcatccttcaagtctctttaagttctacccagaatcgaactatcaccactagattgtcctatcactttgtatgttttatctttttgttcccctcagactgtccaatttctacactcaaattttgtttctggcttaggctttttcttggatagcttatttagagtccctctctgctttaggaaccttgcgtgatacctcacccagttgactctcatccctctctacccccttggttttgatatcactcatacctacagtcaacaacacttatcttctgatctttctctctcccattgcttctcctgccctgttttccaagaaagggattggacacacattgtcacattgtaattattttcataaacattctgaatttgagtccctatctccccactgttgcctcaaaggaaggtcatgatcaacacagaaaagacaacttcttattcctgagattaatctttaaaagttaagatgggcaatgatttgaactgggatttaacaagctgggagcccaatttgaaccgtcatgttgcttaccgttagggaattcagagtaactgacctctccagacagctggtatagccgaactgccaaggatctatttgtaaaatgcactcaggaaatttatggaaaataactcattccaagagcaaagaggtaatctgataagctaaattcatggacaatgaggaagatagttataagtatgagaatatgagctgctcagattcctcaaaggcagtataaataacaagatatgtgtaggtctaatgataccttaaatatgcttgtcctaaaaagtctttggccattgcatcattgtccttggctttctctcctctccttctattaaattttcctctaatcctatctttccgttcatttctaatgtatgcagtttaactgtcttttttgacgtcttgtcacttactgtctaccgatgccttcaatgtctcaccatacatgccaagtgattttgaaaatgatttcttaacacaagtataattaattccttaagaggaaatatgttgtgagctgttaagatcataactctttttcagcctgatgaataaacctctcaagtttttaccctgtgtattctctacaataccagacatgctgaacagtcaatgcagagacctcatcattatcactccaggttgacatgttctgttgaaatgcaagtacatattttatggtgactatgctgtctgtttgcctgagtgaaaagatgtccatggtaatagctatttaagattattgctggatgtctataatttatttattataattattataattcctcagggaaacattacttataattcagcaattcactttatcatctgaatgtttctaggcttgattaatgggccaattttgtatagttatagtatggcattttctttattttgttcacataactatataaaacatatagccttatatacacatatatatgtgtatatatgtgtgtatatataaatatatgctcaaatatgtgtgtgtgtgtgtgtgtgtgtgtgtgtaataatctctttaaagttagtgatactgccatgagatcatcagatcatcagataatcattttggaaattataacaattcatgcccaaagcaggatctacataacgtctttgggcatagttctcaactatagtctaattgtcatatttatatttgcatttgtattgatatttgtaggtagattgcaacatttttgggtattatataatgtactatattacgtttcttatatgtttactttatcagatatataataatgtatctgatataaattaatcttcatcataggtcacttttttagatgtaatgctaaatattttaaaggtgtatgttattctcatcaatttttactttttatttgtcatctcccctgtgtcttagctagttcttttggttttataagaaattatagaattttagagctggaaacccttactgaacatcaaaagactagagccacttatctttgaagcagtcacatgttttctgacttgaccacaggctctgttcactcagcctgagttgtctgactgaatcatggggaaggatttaattcacttttctgccctactaccctccaaagactgttacctcctctatattctggagatggaaaacagaaagaaaataaaataaatggaatacaaattcttatttgtgtaaattgtgatgccaagcactcatattttctcaaccaagttgtctttgctttgccgacttttagcagctatttcctagtgacagctcaaaatttctgtatagcttgattttgggagcagcagtctggtggaagggtcagtcaaggcagttttaaatctggatgtgcctagaaggcactctctttttatttaggttatataatacgaataaaaagagcaagtacaccttctaaaatgcttctttttggttttatgtaaaattttaaaaatgtcaatgtgtttatgaaatagtactactttatgaaacaatatttgatctcacctttggattttatgtagattatttacgggcaggtgctaaagctccccacagactatttctaggccttatcaataaccaagcaagttagtttatttgaaaatagtttgttttatgtacaacaaatattatatatatatatgtgtgtgtgtgtttttaacaaatacatgttttaacatgtatatgctgtttttaagtggtatttttaaataaatatgtacatatatactgtttttaatgactttttttttttttgcagtaccaactatcaaggcttgaaagctaagggtattcaagattaacattatttttaagtaacattttgttaatgggaaagtcattcatccattataccaatgattcttttattttcctccctccctcccttccttccttcttttgttcttttctttctttttgattgaaaaataatagttgtgtacatttatgaagtacaatgtgatgttttgatctatgtatatgtcgtagataagattcaataaagctaattaacttacctatcagctcactaacagcaccatttatttggggtgagaatgttagaaatctatttctttaacaatttaaaatttacaatacataattactaactgcagtcactgtgcagtacaatagatcactaaaagttattcctctagtctaactacaactttgtatccttttatcagcatctccactttccctatcccttggcctcccctaaccgctctgtttttatgataccaacttttttagattctacgtacatgggagactataagcagttatctttctctgcctgccttatttctcttaacataatgtcctccagttctatacgtgttgttacaaatgacagcatttcattctcttttaaggtttattatattccattgtgtctataccaaattttctttatcctttcaattgttgatggacacttacattactctcaaatcttggctatttttaataatgctgaaatgaaaatggaagtgcaaatatctttttaccatactgatttcaatctccttggaaacatattcagacatgggattgctggatcatatggtaattatatttttagttttttgaggaacctacatgtattctccaaaatgattgtactgatttacatttccaccaatagtgtacaagagttccttttctccacatcctcatcaacacttatacatcttttttatagtagccattctagcaggtatgaggtgatatctcattttgtttttaatttgcatttccaaaatagagatgttgagcattttttcatgaatctgttggccatttgtatgtcctctattgataaatgtatattcagatcatttgcccattattaatagttttttttcaattgagttatttgagttctttatacattttggatattagctccttaacagatatgtggtctgcaaatattttcttccaatccatttgttgtcactccactctgttgtttactctgctatgcagaaacattttaatttgataccatcacatttgtctatttttgctttagttgcctgtatttttcatgttgtatctatgaagtcagtgccaaaaccaatgtcatggagattttctctatgttgacttctagtagctgtgaaatttcagatcttatgtttaagcatttaaaatttttttttccataagttattggggtagaggtggcatttgattacatcagtaagttttttttttgttaacattaaatttttaatgtttctttaaacataactctgataaaggtcaaacattaagaaagaactgtaaaaaggtaaaatgagccttggtactgtgttcagaaatgcctcctgttaacacagataatggatttataggttggaagtaaaattttttccaaatgcattagcacaaattgttaaaatggtgaggacttgggtataccccaacaatttattaaattgagtgtaactaaaacaagggtgggaggcagccaataaatgacggacatggtgcttccgccaacaatacaagaataattatgatgtaaatgttgctatcaagtcaaaagataaaattaacagtaaataactacatttccagaaagaaaccacttggggaagtactgcttttgtacctttaaggcaataatattactattattaataaaaatgactgagcactatgtgctgtgtttttctgaaaataaaattataaacaatgagatatgtttataaggatcagcattttattttatgagtcattttaaatgttaaatttagatacattcttcagtgacccataaatgtaacattatttttatattttcaggagtttttgtaaccacataccaaagctgcttcattagcatatgaataattacctttgtatagaggaaattaaatagatagtgagatcctttctttacattagtaagttctttagcagtgatttgtgagattttggtgcacccatcacctgagcggtatacactgcaccctatttgtagttttttatccctccccgcctctcaccattccccccaagtccacaaatccattgtatcactttatgcctttgtatcctcatagcttagctcccacatattagtgagaacatatggtgtttggttttccattcctgggttacttcacttagaataatagtctccggtctcatccaggttgctgcaaatgccgttaagtcattcctttttatggctgagtagtattccatggtataaatatactacagtttctttattcactcgttgattgatgggcatttggattggtttcatgattttgcaatcgtgaattgtgctgctataaacgtgtgtgcaagtatccttttcatataatgacttcttttcctctgggtagatacccagaagtgagactgctggatcaaatttaaaatccattttaagtttatttttgcatgtagtgtaatagaagggcccaatttcatttttctgtgtgttgatatccagttgtcccaacataatttattgaaaagactgtcctttctccactgtgtgttcttgacatctttgtcaaaaatcacttggctataaatacttgagtttatttccaggctgtctatcctgcttcattggttgatgtctctacttttatggcagtaccatgtgttttgattataatatattataatgtcttaaaatagctttataatgtattttgaaaaaagagattgtgatgcctacagctttgctccttttgttcaaaatttctttggctattcgtggtttttctggttccatacaaattgtaggatttttttctttatttctgtgaaaaatgacattggaattttaataggaatttcattgactttgtagatagcttagtttgcatggacattttaagactttctccacttttattcaacataatactaaaagctctagccagaatattagggaagaaaaaaaataaaaataattcattcaggaagggaagaagtaaaattgtctctgtttgctgatgacatgacctgatacatagaaaattttcaagactccaccaaaaaactgttagaactaataaatttaagtaaagttgcaggttacaaaatcaatatacagaaatcagtagcacttctataacaacaagttgtctgaaaaggaaatttttaaaaatttgatttacgatagcatcaaaaaataaaatagaaaatttaaccaaggaggtgaagatttatacactaaaaactataaaatattgataaaagaaagtgaagaagatacaagtaaatgcaaaatatcctgttcatgaattaaaataattaatattgttaaaatgtccatagtacccaaggcaatttacagattcattaaatcaatgatttctaacctcagattcaaatgcaaatgaatggacttcagcaaggagaagaatacccaaaaatttaaacaaaattcacatggatacacactttattatagaaaaggcctataattcatagaggcatactggattatactagtacatatgaactacatatgcttaaccgaaacccccaattctgaaatcttactgtgatagcaatttatttcttcctcaaataaaatttcagggtaatatgtagccttactttctgaaatggtctcaggttcagttttctaaaatttttttcccactatcttatgatatttattgctaggtggcacataaaaagatcagcatttcagccaacatagagatgccactcctttaaaggcaagtctgaaaattgtaccacgttttcaatgaactcccgattaattagaacttagaaatgaaatcctcattctgggtggccatgtgttgaagataaaggattctattacagtagaggaagtaattaatagatattagggacaaccagcactttctggcacaaacatacattgtaaagtgcttacaggaatacctggtagataataagtacatattaaattttagctattttaactgtgggtctttggtataaaaactggaaaaatctggtagtagcagagaagtcagggtaatatgatttataaattaattgcctcatgtaatattgtcttagttgttttatatgtaatttgtttatattttgagtggattaaaataagcaaatctaatagatataaattcatgagtacttttccctcagtgcttggtatacaataatagaattgttagtttacataattcctgtgagataactttgatttgtgatcatcgaaacagcattttatctggtatgagactttagccttaggtattatttccctacataggaatacatattctagatttgaactaaaagaacaattgttctatagtgattatcttgtgccactcacaccccacattgttctattcaatgcaagaaaaagggtttgaatattaaaaagaaatcttatgccaagtgaaatgtatttttgtatacctgaaagcacaagtctgggatataatatgtcaatatttctaagctgtcataagagtgaatattattacatagatattattattgatgttaactatttctgcatgacaaatttggtagccagccatccaatcaagactatggagcatctttgtttttgaactttgtaaaatctatttataaactccataggaaagtagatccattactttatacaactgccgcatgcctagaacaaaacagcattactattttcctcatttggaatatttagaattaaatatcatttattttttccatcaagatggaaggcaaggtgttatagtaaatatgacatattaatttaatattttttatcaagaggattcaaatattagactgggaattagaatatgtgagttttatttctaccttttactccaagaggtaatttatatgtttttttaaactaatttataagggttggtttctaattctaattctatttataactgtgtggtcatggaagggtgatccagatttccaattctataatgttaaatactccagttctaaaaatatctaagatttataaccacacttaatctttgtggatattactatgaaggaaagattttttttttaagaaaaggtattgaccaagacttttacatttcagttgtaagttataggaaaacaatttgaaataaataattattaattgatttgaaataaatttattatttatttgaaataaatagattattaaaattgggagaagtttcttggaaggcaaaaaaagcatctattttgaagacatttcatgaccagatgaatcatagtgctaggtgcaggagataacatgatcagtcagtcttgggcatatgtccactcatgtgcttgcagttcaaggggaagcagaaaataagagttattagacagatgccgacagtaaaactaaaattagtttctaaaatggttttgatcaacaactgcatcattggtgtgagttatctcctcttacaagggtaaactgagtgaacatttgcaaatagaaatatttatgatataatacaaatacattaagattttatatagtatttgtgaatttatgtgtttttgtaagtctagataattgtccaaataaaaagtcacacattcatctgctagggctgccataacaaaattctaaaaattgagtggcttaaaacaacagaaatttatcttgtggtcctggtggtagaagaagtctgaaaccaagatgttgatgtggttggctctttctgaggcctgtgaggaaaggctctgttcaaggtctttctccttagcttgttatggctgccttcatactcacatgtcattctccctatacacatttatgtgtcaacatttcccttttattataaggacatcaattattttggattagggttcactcaaataatctcattttaacataattacctctataaagaccttatctccaaataaagtcatattttgaggcactgcaatttagttcaacatattaatttgagggggggaacaattctactcataacaactggaatgagaccatagaaccacaggcttaatggatttgatctattctagtagtagcctttttattcctggtgccatttcttccatcactgacatataatgtcattgttgtaagaagaacgcccctgcccaccgcccccccacacacacacatatagtgaggatgttcacattgtccactactccagtagctcctctactcgtcaggcaggacttactcaggttatggaaggtagggccaaaaaaaaaaaagtcttccccaaagtgttatgcttggtggccatatggacagttagtattagtggccatatggacagtttggtctatcaaactgattgtccctgagcaactcatgctgatgcacatccctccacagtctgtggcaactcttatttggaaaatgtccagaggtgccctccctgtggtttccaaaatcactgttgttttttttttggcattatatgctaaatgactatttccatatcagcccctcaagaccaaagtaacgagaaacagagattttcagccttttccacacatttttttggatacttctttctccatgaccacacagctctggaagtaagcctgattcacctgcccagactattccaagtgagtatcccttggatgaccttgatttactttctgccagcattcctcagcctagttgacttcaagccatgagatcagagagattttactgaaactgagtctcaaaaagagaaaggttgaccataaatatatatacctacaatatacctgcaaaaaccaagtataaaacaaattaaagaaaggttggaatctaggacctgtatttttctctgaggctacttggtgtctatgtagatattttgacccactcatcaatgatattaagtaaatacacattatcaattaaccaccaccacttaccaaatataatctattccacacttttttgctagagtaccaaggaccatctttccttatatgaccttagctagatagaaacaatcaagagatttttcctagaacaataagatgaaaaggcccactccatcaaaatataatttaaaaaatatttatagagatggctttcatacaagtatatattgaacacatttcaaaatgtatttaattctctgagggagccagcaagatggtaaagtaggttcaaaaaacatttgtacagatttttgcaatcagccagaaaagaaatgtataaatacatttatcaagttaaaatacaaaactggctaatatcctacatgccaattatactataacctttggggttatcttttctactatacaaaaataatctccattttttctaaaaaaatttgcaagttcagaattttttttttagtttaatgaattcacaatatttatagaatctatgagtagggtcctaatcaataacaagagaaatttacttatgagtacattcaccttaaaaacaagataacctttaattgtgtgttttatttagcaaaccattttcacattactttttttagtggttacataactttgcattttttaaatactcttggaaaatttggataggtctattagtgcttgagtgtggcacagaaaaacataaaatcatctttttgtgttgtttccatattttagatatttttttcttaactactctaaagttgtataatgcctgtcatagcttcatgagaaaaatcaatgtttaaaattgttttcttataaaaaattaaatttttttcatcacatggcattcagctatatgttaattattacaagcaactaaggtcttacaatttattatccacttgtatgaccactttacttttagcaatgtagtggactacaaaaatataacaaataaaaagaggaaaagtgacatcgagatgacacagtagaaggcaacgtgctcaaattccccaacaacaagaattctgtagccattcacaggtaaaagtctctctgcagtggccttggtatttaggtaggagttctgtgaaaccctggtaaagcacaggaaccaggaagactgttttgagaatgcagaacagcaaccaggttgcagatccactgatgatgttctcaggttcaaacccagaatcagttccattccccaaaggctttggctacagcaccatttggccttgagcctacaactaaaaccatttgccaagggagccagaaggaatcatgaacaccagtgtctcagcaagaaaagatcattttcctgctgacattgatctctgcaatggaactgaaacttgtcctgtggctcaattccagtccagcccagttgaagttccagcttagaactgctcacacaaggaccacagagagactttcccatatgttgcacacagaatctgagccaaaataaggggcttaccagccttcatcccatagcagatcttgagcaagcccagtctcacctctgggacctcttgttgcaatcagaaaactatcccacctgtgcagggacccacaagggtatgtgcatccagctgagctaatgaaacaggctcaccagcctctgtctcacatcatattctgagggtgccctattttggctccagctcctcgcactatagtccatgaactattctgcctgtgcaggatcctgctgggaaacacatgcctgccttattactcagtgagatgggcttgacagccaccatcctacaggagggccaaaaagcccctttatcagctccattttctcctgctgcagtcagagacctatcttacctgtgccaagacctcctgagagacacacacccatctgaaccaaggagatggactcccaacctccatttcacaacagatcaccaggaggcccagctcacctccagccacacatgctgtagtcaggaacctctcctgcctgtttgaggtgctgctgagatacatgcacccatctgagccaaagagaaaggctcacagttagccatcccacagcagatcccaaaggggccctgtctcagctctgaccctttgtgctgcagttggagcccactctcactggtgaagagacatgctaggagatacatacctatctgagccaaggagatgggtgctccaacctctacccgacagagattctgagtgggccctcattcagttccaagccctttcactgcaggtggtgaactatcccacttctgcagggagcttcagtgagatgtatgcctggcagagccaatgaaacaagtcaccagcctctgtctcataacagatcctgagggggcccaatcccttctccaaaccgtttcactgccgctgagggaccattctgcctctaaaagagtagtgcttgggtggtgtacctgtatgggccactgggaaaatctctggctcaagtttctggccagctttcccacaaagccaaggtacccccaccttgagttttccccaggtccatttgggccagaaaaatcatgctgaccacagagcccttgcaagacttgtggcaaacctgtgcttagagcaccagagcaccctctagggtttagatggctgcagtggtgacaggctctggcaacacaacagtctggttaaaaccgctagaaggcccaatgagaagaatgagcacaggcaaaacctgattcaagaaaacacaaagcaatagtccagaaactcatcagagaaattcagtagagataataatataaaacaggatattggagctgagaaaaacaatgagctaaatgaaaaatacaatagaaacaatcaacagtagagtcaaaaaaaaacaataaagaatcacttaacttgaacataagctatttgaaaatacatacatattataatcagactctcaaaggtcaaagacaggattctgaaagatgtgaaagaaaagaggcaaacatataagagtattcaaatacccttggcaacagacttctcagcagaaaccttgcaggccaggagggagtggggacatatagttagggtgctgaaacaaagaaacagaaaacactgtcaaccactagtatagcacctgggaaagctgtcttcagaaataaagtagcaataaataccttcccactcaaacaaactaaagggatttattactatcagacctgtcctacaagtaatgcaaaaaaaaaaaaaaaaaaaaaagtgttgggggagttctctaaactgaaaaaaacgatgctatcatgtaataagaaaacctgaaggtataaaagtatacctgaagacataaaagccattggtaaaataaggtatatagacaaaatatatttactttaatcattgtttgtaaagaatatctttagtataaagactaaatacaaaactactatttacattaatttgttatgaaataaataagaaaatataaaatgtaatatcaaaaattttaaaggacaaaatgaagttcaatatacatttttttttgttattttcttttctttgcactcaaagttgttaccagtttaaaataacttgctatgacaatagaatactttttgtaagcgtgatgataaccataaaacaaacacttataaaagacactaaaaataaaaaggaaggaaatgaaacataccatatgagaaaaaaacacttatgcacaaggaaagacagtaagagagaaaggaagaaagggtgtacaaaagtactagaagacaagtagcaaaatggctgtagtgagagttcttacccatcagtagttaccttgaatagaaatagattaaattctccaattagaggacatagaatagctaagtggattttttaaaaattacatgctgtctacaaaaaacttacttcatctgttaaaaacattgagactaaaggtgaagaaatggaataagatattccatgcaaacagaaaccaaaagaaggcagaagtagctgtacttatatcaggtaaaatagactttaagtcaaaaactgtaaaaagagacaaagaaggccattatgtaatgatgaaggggacattacagggaaaggatttagcaattaaaatatgtatgcagtccatatgagaatatttaaatatatacagaaaatattaatagatctaatgacagagtcagaccacaataaataggggattttaacaccccatttttagcaatagatcattcagagaaaatgtcaacaaagaaagattagtgctaaactacattctaaacacaatagaactaatagacatttaaagaacattccatccaacagcctcagaatgcacattactctcaacaacacatggaacaatctgcagaatagaccatgttagaccacaaaacaagtcataaggaagtttaaaaaatcaagttgtattaagtatcctctctgaccccagtggactaaagttagaaattaataacaggaggaactttagaatctatacaatgcgtggaaataaacaacatgctctgcaataaccaatagctcaatgaataaattaagaaaattgacaaaaattttttgagacaaaaagggaaacacaacgtaacaaaacctatgggatatagcaaaagctctaaatgtataaatgactaaaaatgtacaatgatacggtttgtgtccccacccaaatctcatcttcaattcccacatgttgtgggagggacccagtgggaagtaactgaatcatgggggcaggtctttcctgtgctgttcttgtgaaagtgagtaagtctcacaagatctgatggttgctgtaacagggagttttccagcacaagctctcttcgccttatccacgtaagatgtgacttgctcctccttgcgttctgccctgattctgaggtttccccagccatgtggaactgtgagttctccactaaacctctttcctttgcaacctgcccagtcttgggtgtgtctttatcagcagcatgaaaatggactaatacgatcaatgaagcaacaattttgttgtttgaaaagataaacaaaatttaccagccttctgctaaactaaggaaaaaagagagaaggcccaaataaataaaatcaggaatgacaaaggagtcattataaattataccatggaaatataaagaatcatgagggactactatgaatatatatcaacaaattggaaaacctgaatgaagaaggcaaattcctggacaccaacaacttactaagattgttatgaggaattgaatatctgaacaaaccaataaagagtgccaagattgaatcagtaatagaaaagtctccaatcaaaggaaagctcaagacctaattaaaggcttccctgctgcattccaacacacacctaaagaagaactaatacccattcttctcaaactattcatttgaaattaattctaagagcctagcattgtcctgatacccaaaccagaaaagaacacaacacaaaaagaaaaatataggccaatatcacaatcctcaacaaaataccagcaaaccaaatctaacagcatatcaaaaagattactcccctcgtaaagtgggattcatcccagggatgcaaagatggttcaacaaatgcaagttaataactgtaatacatcacatttacagaatgaaggacaaaaatcatatgactaatagacagaaaaggcatttgataacattaaacatccatttcctgataaacactctcaacaaattatgtatagaaggaatatacctcagcataataaagcacatatatgacaaatccacagctaatattatataagaacagggaaaagttgaaaacttttcctgtcaaatctgaaacaagaaaatgttgcctactttcaccacatttatttaacagaataatggaaagcccagccagactgttaagcaagagaaataaataaaggacatccaaattggaaaggaggaaatcaaattgtccctgtttgcagatgacataattttatatagagaaaaacctaaagactacaccaaaaaactgttagaatgagtaaacaaatttagtaatgtagaaggatataaaaccaacatataaatttcagtagcttttctgtatgcgaatagtgaacaatctgataaaaaaataaagcaatcccattacaatagatatcaacaaaaataaaacatatataaaaatttaatcaaggaagtaaaagatctctgtgatggaaagctacaaaatattgatgaaagaagttgaggacacaaatacatgaaaaagataccatgttcatgaattagaagaattaatgtagctaaactgtccgtaatttccaaagcaatctacagtcacaaaacacccaagacattcttcacagacacacaaaaattcctaaaatttgtatgaaacaaaaataaccttgaatagcataagcaattttgagaaaaaggaacaaatctgtaagcatcacatgatctgacttcaaaatatagtacaaagctgtagtaaccaaaacagcatgataccggcataaacacagcagcatagagaacccagaaaatccatggatttacagccaattgatttttgacaagaacaaggatgggaaaaggacagtctcttcaataaacggtgctgagaaaactatatatccacacacacaaggatgaaactagatacctattactcggtacttaaaaaatcaactcagaaaggaatagacttaaatgtaagatcctaaagtatgaaactcttagaagaaaaaatatacataaaacatttattttgtgatattggtctaggcaagttgttttgataaaacctcaaaagcacaggcaacaaaataaaaacagacaaatggaataatatcaaattaaaaacctctgcacagaaaaggaaaaaataaacagagtgaagaaataatctacattatctacataatgtgataaaatatgctcaaactataaatctggaaagggttaatgtgtagaatatataaggaactcaaacatttcaatagcaaaaaaatcaaataatgacttaaaaaaggccaaaacatatggatagacatttcacaaaagaagacatacaaatggcctacaagtatattaaaaaatgctcaacattaataataattagggaaatataaatcaaagccactatgagatataatctcagtccagttagaatgattgttattaaaatgacaaaaaaaaaaaatgacatgaatgtggagaaaggggaactcttgtatactattcgtgggaatgtaaattcatacagccattatgaaaaatagtatggaggtttgcccccaaattaaaaatggaactaacatttgatcttgcaatcccactactgggcgtatagccaaaagaaatgaaattggtttgtcaaagagatatctgctcatctatattcattgcaacagtattaacaagagccaaaatatgaaatcaacccgagtgtccataaatgaatgaaaggataaataaaatatggtatattcacacaatgaaatagtatttagccataaaaataatgaaatgctgccatttgcagcaacgtggatgagcctggaagacattatgttaaatgaaataaactaggcacagaaaaacaaatacctcattatctcactcatatgtgaaatcaaaaaaagtagagagtagaataatggtgaccggaggctgaaaaagtaaaggatatggaaggataaggagaggttggttaatgggtataaagttacagttacgaaggaggaataagttctagtgttgcattacacattagggtgactatagttaacaataaaacatatatttcaaaatagctacaaaagaattttgaatgttctcaccaaaaagaaatgataaatgtctgagttgatgtgtaattagaatatttttatggggtacagtgtgatgttttattacatgtgtacattgcacagcatcagcaatatgcaatgtatgcatgtattaaaacatactgtaccccacaaaatgtaaaagtattatgtgtaaatttaaaataaataaaatttttttcaagagaaaaaacttaatttctcctaaagtatgtgctgaacacaaaaatatgcctatttctcgtggtaggagttttatacaacaagttggcaaggttgttatttaacgccaccactaatgcactgaagtattaagtgattggtcctaatcactagacctgtgggtgatggaacaggaccattagccctgctatctaggctcctaagtccacaatcttttcccaataccatctcaaaaataccttcttgacaattctcaggggaatttattagaagagttaaatttaatgaggtaattatcaggagtttggtcaaaaagctctaataggatgaaagtaagtctgtttgaaatgactaaatgagcatgaaagaatgccaactattctaattccatgtaatggaaaaggattgtcagcttcttttgtgttttaaactgcacaatagatatgacagatttgaaaaacaaaggaaagaaggagatgaccttagggtcagagttagagtcattgcaactggtttgaacagatgattgaaattaagaaaaaaaagctgggaagagagtgttaatgaaagaagtacagcataaagatgcgggataaatctggagtccttgattataatcatactctaccaccaaatctgtatggccttagcagattaatgtgcttctataagctccaattccttattgtgtaggtttaagttgttgagctagatggtctctaaggcccattatagctttaatattccttgaactcgtttaggagtcaataatagaggactaacaatatatacacagtaacatcattttcttgcttaaaaattttcagtcagtctctattgtagtatagcactgtcattaagaatttgcttaatttccctgagttgtaattttcttcaattttgtgaatatttaagatatttataaaagtatatcacaatattcaggaaatggtaagcattcaataaacattgtctgtcaccattttttgccctatatatcatactgaagaaacacaaactgcttatagttatattctgtcctttatatatatatatatatatatatattttttttttattatactttaagttctagggtacatgtgcataatgtgcaggtttgttacatatgtatacatgtgccatgttggtgtgctgcatccattaactcgtcatttactttaggtgtatctcctaatgctatcccttccccctccccccaccccacaacaggccccagtgtgtgatgttccccttcctgtgtccaagtgttctcaatgttcagttcccaccgacgagtgaaaacacgtggtgtttggttttttgtccttgagatagtttgctgagaatgatggtttccaacttcttccatgtccctacaaaggacatgaactcacccttttatgtggctgcatagtattccatggtgtatatgtgcaacattttcttaatccagtctatcattgttggacatttgggttggttccaagtctttgctattgtgagtagtgctgcaataaacatatgtgtgcatgtgtctttatagcagcatgatttatattcctttgggtatttattaagtaatgggatggctgggtcaaatggtatttctagttctagatccctgaataatcgccacactgtcttccacaatggttgaactagtttacagtcccaccaacagtgtgaaagtgttcctatttcccacatcttctccagcacttgttgtttcctgactttttaatgatcgccattctaactggtgtgagatggtatctcattgtggttttgatttgcatttctctgatggccagtgatgatgagcattttttcatgtgtcttttggctgcataaatgtcttcttttgagaagtgtctgttcatatcctttgcccagtttttgatggagttgtttgtttttttcttgtaaatttgtttgagttctttgtagattctggttattagccctttgtcagatgagtagattgcaaaaattttctcccattctgtaggttgcctgttcactctgatggtggtttcttttgctgtgcagaagctctttagtttaattacatcccatttgtcaattttggcttttgttgccattgcttttagtgttttagacatgaagtccttgtccatgcctatgtcctgaatggtattgcctaggttttcttctagaatttttatggttttaggtctaacatttaagtctttaatccatcttgaattaatttttgtataaggtataaggaagggatccagtttcagctttctacatatggctagccagttttcccagcaccatttgttaaatagggaatcctttccccatttcttgtttttgtcaggtttgtcaaagatcagatagttgtagatgtgtggtattatttctgagggctctgttctgttccattggtctatatctctgttttggtagcagtaccatgctgttttggttactgtagccttgtagtatagtttgaagtcaggtagcatgatgcctccagctttgttctattgggttaggattgacttggcaatgcaggttcttttttgtttccatatgaactttaaagtagtttttcccaattctgtgaagaaagaacattccatgctcatggattggaagaatcaatattgtgaaaatggccatactgcccacggtaatttatagattcaatgccatccccatcaagctaccagtgactttcttctgttccttcttatgctttcatgaaataaagggcatagaaaatatataaaatacatatataaaagcaagaataaagctttcgtgaaataaagggcatagaaaatatataaaaatgaccattcaaaggcccaaagtgatcctgggtctttgtttctcattcttgacaagttaacataaaatttcttacactggttttcctctttagtctaaaaatttggcccatgaagttgtgttgagatgcgttattgtaaatatttatgtggcattaaataaaatcttcgtagcaaatacacattatttaatgacaccatttgcatggaaaaatcaacaaatcttacagtaataatctcttcacacaaattttacaaatattcttgacttcactgacactttaattatcaagtggcatgtctagtcccaaagtaaagagtatgcataatcagtcaattcacttcatgtgttgtcactaatcttaatactgtactccacaacttcaaaatctgtcctctaccattgtggagagcaagataaaaggtttaatatacttatcatttaacattttgactaatttattttctggtgaatttaaaacttaaggtaaattttttgaagaaggatttttcatttgttttaacagaggtatcgatatcagcatttagatatctttgactttttcctgtcagaataatcaattaacttgattttacctttcatggtccatttaatttcgtattgaaagatttcttttctttccccccctactatgctgctccttgcggtgattatgtcaaacaagcatctatttttctatttctggacaccataagactacaaagttatttatttggttgattgtttgatgctccatcccccttcaagccccaccaaaatgatatgatgtagcttatgagattatttaggtgtagtggatctagccttggaaacagcatttttttccccatagaactaaatttcaagaggaatttaatacatggtccatttgaaatgaacaacaaaatagaaaatacagacgtaccttggagatactgcaggtttggttccagacaaccacaataaagaaaaaagtcatatgagagtaagtcacacgcattttctggtttttcattgcatatacatatatctttatatgatactgtagtctattaagtgttcaagtctttaaaaagtacatacgttcattaaaaatacttcatagctaaaaatgctagtgattatctgggcctttagtgagtcataattttttgctggtgagaagttttgcctcaatattgatggctgctgactaatcatggcagtagttgctgaaggctggggtagctgtggcaagttcttaaaataagacaaggaactttgccacattgattgactcttcctttaacaaaagagttctctgtagcatgtggtgctgattgatagcattttacccacaatagaacatccttcaaaattggactcaatcctctgaaatcctgtccctgctttactaagtttatgtaattctctaaatccttagttctcatttcaacagttttcacagtatcttcactgggactgaattccatctcaagaaaccactttgtttgctcattcacaagaagcaactccttatccattcaagttttatcatgacattgtagcaatttagtcacatctttagaccccacttttaattctagttttcttcctatttccataacacatgcagtcatttccttcattgaagtcttgaatccctcaaagtcatctataagggttggagttaacttcttctgaactcctgttaataacgatattttaacatttgcccgtgaatcacagatgttcttaatggtatctagaatgatgaatccttttagaaggtttccaatttacattgcttggatccatcagcccaataactgctatctatggcagctatagccttacaatatttatttcttaaataatgacttgtaggttgaaattacttcttgatccatgggctaaaaaatggatgttgtttagcaggcatgaaaacattaatctccctgtacatctccatcagagctcttgcttggctaggtgcattattgatgagtagtaatattttaaaataaaattatttttttctgagaagtaggttccaatggtgggttaaaaatattcagtaaactatgctgtaaacagatatgttgtgatctaggctttgttgttccacttataggcacaggcagagtagatttagcataattcttaagggtttataagggccctagaatttttggaatgttagcagggcattggcttcaacttaaagtcatcagctgtgttagcccctaacaagagaatcagcctatccttttagccttttaaatcaggcattgaatttcatctattctcttagttagaccttctgaatgtctgaataacttgctgcagcttctacatcagcactttcttcttcaccttacaattctatgttatggagacagcttctttccttaaacctcatgaaccaacttctaataacttcacacttttcttctgcagcttcttcacctctctcagcctttgtagaactgaagaaagttaggacctttctcttgattagtctttagcttgagagaatgtggctggtttggtcttctattcagattactaaaactttctccatatcagcaataaggctgttttactttcttataattcatatgttcactggagtaacacttttaatttctttcaagaacttttcctttgttaacagtttggaataagaggccgttctttcattatttattggctttcttcatgctttcctcactaagcttaatcatttgtagcttttgatttaaagtgagagacgtgcaactctttctttcatctgaacacttagaggcccttgtagggttattaattggcttagtttcaatactattttgtctcagggaataagaagtccaaaggggagggagagtcaggggaagggctggctggtggagcaggcagaacatacatacacagcatttatcaattgagttcatggtttatatttgggcatgatttgtgattctctaaaacaataatagtagcatcaatatcactgatcacagatcactgtaacagattcaatattaatgaaaacgtgtgaaatattgtaaggattaccaaaacgtgacatgagatgggaaataagtatctgctgctggaaaaatgctgccaatagacttgctctttgcagggttgtcacaaatcttcaacttgttaaaaaatatatacacacacagtatatatatctatatagatatagatatatggtgcaataaagcaaagaaaatgaggcatgcctgtaccaaacaccttaatctaaacaacctatgtttctgccatgacacgtgtgaaacaaaccaatattgcaggaaagaatatctcaaatttcttctttgcctatcatttgactgacttatccactccatttttggttgttgtcaactgaacaagcaattgtatctaccatcaatgaagaagtaagtaaaagttattttgagagacaaatgtttagatgttcatacaccttccatttacacaccccaagaaatgataggttccatgctccaaattttgtctcagcattaaagcacagccttgaatttcatgtgctggatgctcttgctggataaagctgaacccctgacagccatgcaatgatgtacagaataaaatagtattcaggaagtacttcagtactgacaggaccatcaaacttaagataagtatttattttgtgtcaaattattttattgtaaagtaatgaaatcacttgattgctatttttcagtatttctaagaggatatcagaggactcacatggagtggagtgaagtgaagggaacaggtaagatgttaaattttgggcaaactttatagcagtgttccaggagcaaatataaacttgcagaagacatttctctaggttggtgataagaagggaaatcttagacacatgagatgtataaaagtatgtgttaatctaagttgacagaaagttcacaagaatagaaaaacaggcagaatagagtagaatgcataaaaatagacccaaattaatatggaagtctatcgagtacaaaaaagcggcacctcaaatcactgagtcacaattgactttttaatagatggtactgggacaattagtcatttggaatataattttgatccatcctttggcccgtccttaagaatgcactctgaaaagatcggcaatgtaatagtaagacatcacaccatgaaggtaatggaagacagcaacatttgtaaatgttttattcacctttaaataaaacaggttaaattgcagtgcattcttctttacataggtgtagagaatgacattctaactgtaaatcaaaatccagatacaattaaaaaattgataaatttgaatacatataatttctaaaaacagttttcatgaacaaaaacaaaacccactacaaatgaagttaattaaaagactgacaaactgggagaatacatttgcaacatagatatatatatatatatatatatgtatgtatgtatatatatacacacatatatatgtatatatacacacgtatatacatatacatatatacatatacatatatacatacacacatatatacacacacaaatatacatatacatatatatgtatatacacatatatgtatatatacacacatatatgtgtatatatgtatgtgtatatatgtgtgtgtatatgtatgtatatatgtatatatgtgtgtatatatatgtatgtatgtatgtgtatatatatatatacacacatatatatatatacacatacatacaggtgacaattgaataacacaggtttgagctgtgcaggtccacttatatgtgtattttcttctgcctctgccaccacctagacaacaaaaccaacctctcctcttcctctcctcagcctactttatgttgataacatttgtataagaaaaagagacattagaacacaaacacacatctgttcatttgcatggaaacaaatacaggaaaagtaaacagagtttgataatttggttgtttctaggttttggctaataagaataaaactgctgtgaaattttatatacaaatctttgggtgtttgcttttatttatttatttttaggtgaatcctactaatccaatggctagaatgcataggatgcttatgtttaacttttggaaaaatagaaaaacttttcctaagggcttatatcattttatattccaatttgcagtgtattaaagttctagcctgtcaccaactcttgtcaccattcaactgtaggtacgttagcagtttgtgaagcattaacttgttgcggttttaatttgcattttcctaatgactgatgttgagtaaatttttaaatacttatttgtcatcttaatatctccttttataaggtgtctgttgaaatatttttccagttttaatattggcctttttttacttattattgagttgaagtgttctatttaatatactacaaatgtaagttctttgtgaaatgcatgttttgcaaatatgttttttccagtcaatgggtttcttctttctcttatctaatggagtctcctaaagggcaaaacttttacatttttttaaagacctatttattcttttatgtcctattaaaacacctttgccaaatccaaaatcttctgttgtttaaatctagatgtttgatggttttagctttaggtctgtaatctattttcagttaattttcatacattctacgaggaaaggttcgagatttacttttttatatatagttactcaatagttttggggcaacttattgaaaaggttatcttttcccacattgaatcactttagtacttttgaacaaaaatcacttgaccaccaggcctgctttgcaagagctcctgaaagaagcactaaatatggaaaggaaaaaccattatcagccactacaaaagctcactgaagtacacagaccaacgacactatgaagcaacaacataaacaactctgcatcataacaaactagcatcatgatgataggatgaaattcacatgtaacaataataaccttaaatgtaattgggctaaatgccccaattaaaaaattcagaatggcaaactggataaagtgtaaagtcccatcagtgtgctgtcttcaagagacccatctcacatgcaaagacactcataggctcaaaataaagggatagaggaaaatttatgagcaaatgaaaaagagaaaaaaggaggggttgcaatcctggtctctgacaaaacagactactcgctttccaagacttggtcaaatcttgaagcatggatttttatgctacaggaataaacaaacatatcttgctggcaaaaatgtgttgattggccgggcgcggtggctcacgcctgtaatcccagcactttgggaggccgaggtgggtggatcatgaggtcaggagattgagaccatcctggctaacaaggtgaaaccccgtctctactaaaaatacaaaaaattagccgggcgcggtggcaggcgcctgtagtcccagctactcgggaggctgaggcaggagaatggcgtgaacccgggaagcggagcttgcagtgagcagagattgcgccactgcagtccgcagtccggcctgggtgacagagcgagactccatctcaaaaaaaaaaaaaaaaaaaaaagtgttgattataatccttcctattttgattaataaagatgtgtttgagcctagttataatgatttgaaattcatggtttgaaacctcaattatgtttgcaccaacctaatataatcagtattttccccttaaatgttaaatagaattcactaatgaagccccctgttttctttgtgggaaatttacacacacacacttaagttattcctttactaaaatttgaatttgatttttttcaaagtggttgaaattaataaatgacatgaaatttttacctttcaaaatactttcctattattcctttaatgttgattttttttttttctctctctctctctctgcagtctggctagggatttattaattttatttattttctcaaaaaactagcttttggtttctttgattttctatattgtataactgttctttattttaatgatttctgcttttcattgtttccttttctctactttttataggtttaatttgctcaactttccaagtgtcctgaggcaaaaattaaaaagtcattatctgagactttccttcttatttaatatagacttttagtgctctaatttttctctgattactgctttggctgcatctacaatttttgtaatgccatgtttttatttttgttcacttaaaaatactttctaatctctatttttttatttttcttcaaaccatgtgtaagtgtgcaatttagtttccaagtatttggtaattttccagctgtctttctattattgattatggtttaatttcattgtagtcagaatatacacatttaataaggtttgtttaatgaaccagaagatggtctaattttgtaatgtttcttatgtacttgtataatacacatattatgatgttggatgaagagttgcataaatgtcaaataaatcaggtaagttgataggttaaagttatatatatctttgctaattgtctgtctacttgttctgtgaaatgttgagagatatgctcaaatacattttgaattcattcctccttttattagtataagattatgctttctgtcctgtgaagttctgctattagatgcattattatcttcttgatgaattaattctttttaattataaaattattcagttattctttgtaataatttttactctgaattatactgtgatattaagtttgccattctacctttcttttgatagtgttagcatgatgtagtatttcctatcatttgatttgtctttataattaagatgaatttattttaggcagcacagagccttgataacattcaatctatttttctgctttttgattggtgtttacatcatttacatttgatatgattacaaatatagtttggattacatcttccatcttgctatttattcccatttgtctcatttttactttatcaatatttttctcattttctgacttattttagattaattcaacatttttaactattttgctttatcttctttcttagtttattagttttacctatgtattaataaaatatgaatattctttaggatttatagttcttttaggatttatagcatacatttttaaattatttagtgatatactctctgtacactggtaacaccagagcactttattctgaaattctttgtaatgttgttaatataaattttatttgtacatatttcataaactctatataatacattgttattgtttttgtattgtcaattatcttcaaacatatttttaaaagagaaaatatattcattcacatatttgccatctgttttttttctgtctgaaggactttctttaaaatttgttttagtgaaaacctgttgttgaattatttcaacattttatatttgaaaaacactttattttatcttcatttttgttagacctattcattggtcacagaattcttagttgactgttttgtttgtttccagaagtttcaggatactgcttcattgtcttctgacaagccttgtttctaacaataaataatttccttgtcatttttacctctgattctctgcacaaaatatctctgttttatctctggatacccttaatatttctctttaccaatttttaatcaatttcattatgatgtgtattggtgattattttttcatgtattttaatgcctttctatggccccaattatgcataatatgaggcagagtttttttccttaactctctgatgctatgattttttaactacttttacctatgtgtttcattttagacagtttcttttattatgcatcaatttcaccaatatttttcccagtgtgtctattctgctccttaccctcttcaggatagttttcatctcgtgcaattagtttttctctctagaaattcaattttgcatttttctgtcttctatgcttctctttaaagtggtcatggttttgcctactttctttaccatatggaatgtattttaactcttttatgttcttgtttactaattgtcacctgtgtctttttgttttttattgatttatttttctccttattagtggtcatatattttccacttccttcacatctgtcaatattttattagatgtcaggcattgtgaactttagcttgatgagtactaggtattagtttccttaaatattcttaagctttattctgtggttctgtggtgcagttcagtttcttaggatcagttttttcctttgaagcctgctttcttagctttcttaagttggtctggaacagtgccgcttttttccaccctattcaggtgatagcctcctgagtcctctacctgatgcttcatgaattatgatgacgtttttcaccctgtttagtgggaacacaaactgtttctggccatttgtgagcttcacagcttcttcctctcgcctctttgtggtgtttctttccttggtcttgattaattcatcacactcatgcacagccattactcagtggaagattcaggtggaactctatgtagatctcacctgctttttatgtaggctgtagtgaattcttgtaattttatgtcaccttggtatccattttgaatatatgtttaactttctcataccagaagcaaggcttagctactcttaacaaaactcacacttttctgcttcctcccagtttttcattataaaagacagatatgtgccttatacagctacagctggtgaacacctccctgtgggatttagagatacaatctacttgacttgccccactgactcccacactccacatggactgcatagatatctcttaatgatcacctcttagtcacagtatggccccactgaatgcttgttttaaacccatgaattagaactctccacaggaaagttccttggataacaccccggatccctgtaaaggccttggcccataggtccatctgtctctccggctcctcactttcaggttgaacacatggcccctgcgatctttccattggcccttgttggtacttctcttttgatgacctataaataataaatggcttctgttattttatgtgtttttgttctgttgactcctctgtgtctcacctgacttacccacatggacctaacttttctcctggtcaaggctctccttaagagtagatatgatggtagaaataaagtggacaagggtaagaaaagatatacaagggtatatgtgagtataaacaacacgttttgagaggaacacctggtcatgggtcagatacttaggcattaggttattcgccaggataaaaaaagtatcccccaaaaggcaaactgcaaacattcaaaaccacatcccttggattcccatgagagtaaagctactgattatagtcactatccagaaaaacacctcgaggccaaattagagcaaacaacgtagttccctccactgtatgccactctctgctctggtacctgcccccaaaattgtagccaccacaacctcttcatatttcaatcctgtcactttgatagagagaaagagtgccaggctttctcaggactccaattcccatgctaaaacctggacattatccagaaagcaacctggcataatagtagggctcaccttgaaatttcccatatcttggtaattacttgtcctaaatagtggttgtgaaataactgaaaactatttttgcatatattatgcccattttttaagttcaacaacttaagatgaaaaggaaaaccagtccctattattctataatggttgtaaatgaaaagttagctgtatggtttaaactaagtttctcaacttttcatagctctattttctggaagtgtaaaatgaaggatattatcattaccttacagtgttatggtaaggattaaataatattgaccttgatacagacatggtataatgtctctactttttaagagttttatcaaatgttagtttctctcttccactcattctccttaatcaaaaataaattagcataatttgaatatgcactttagcccataaggtaacataatttcttattttatgaggaagaaatagaggataatctatccccttaaaagaattgtctgaaatgtgttacagaagaaaatactttttactatgttttatcagattagactcggagctcccgcccttccccctccaaattttatagaaatcaaacagaattaacctgctgaattaattacctgtgttttccacaacagatataaaactgcttctttcacatatgaaagcactgaaggtagagactgtgactatacccacgcatagttgccagcgtctaagatggacctcatagatcttccttctgatgctcattcctttgcttagttgcctccaaaaatatatcagggctggtctgcgtgtccaatagaataaagtagaaacaaagaaatgccagcttgtgattctggagacctttctaaaataacttactctgggaaaagccaactgccattgtatgagcagtcatatggagaggtccatgtcacagggagctgaggcctcccaccaactgccatgcaagtgacttggattggctcctccagccccagtcaagcttccggatgactacagcttcagcatatatttggctgcaaccttctgagtgatcttgagccagaatcactagctacactactcagtttcctaatatttagaaattatgttagatattaaatgtttaatcactgaattttggagtaatactttatgcaggctagataagtaatactgattctgctactgcaatgtgggtatgctatcataacaaatatctaaaaacttgaaaactaggaagtggttacaagctgaaatgatattaagaagagtgttcattgaaatgttgagcatgtgttcttttttcctgctacttatagtaaatgagaaatgagagaagtaaataaaaggaaaggctaatatatgtgtaaaaagttgagatttcatagttttaaatttttaagcttccacaggtagcaaaagattttaaaattaagacatggcctctgaacaaagagcaaggaaaacaaggtccaaagatgcagtaaataccatgtttaaaaattatgtttatcttaggtaatttgaagacggtacttccacatacaccgttctgtcaggtaaaagtccttccagacagactgggcttctaggagtgttatctgtagagatccaaggtaaagaagggcttattttggagaaatttgtgggtgtggattttacataatggaatgaactgcaagaagattcacaagagatttaaaaagtttttaagataatatatcaatagaaacaatgccagcttggatgaaaagggacagaaggagtacaaaatgaaaggcttttgggcctgccaaatttctcctagcaggaaataggctgaaaggactacttacctgcaaatacatactacatctcctgtaaaaggaagagtggttcagtggaaacaagaatccagaagggaaagccaagggctatgacttctgggcagaagcaaactgagacttaatcaaagaacttgctacattttcccagttggatctcagaattgctagaaaccaagactagtatgtgccgctcatttctctcttttattgaaaaggaattgtaaatgtatatagaagtgtgtgtttcacatgtgggaggtatgcatatcattacagccacagggcacattgtggtaataatcctgtaagatacccccaactaatccccacctcctagtactcatgtccttgtgtattcccttcccacattctattatggaaggtctgtgtgtctgatagaataaaacagaagagacagggtgagactttggaatctataggacataaaagacattgaaaattctctctctctctctctctctctctctctctctctcattataaacaaacctatacaattgatatttgaatcacattctgtagcccatgtcaaccctccagatgattgcagccccagctgacagcttgactgccaccttgtgtgagaccttgagttcaaacccttcacaaatctgctccaggatccctgattctcataaaccattaatatgaataaaatgttgatttaagctgataagtgttgggggtattctactcaccaaaaatagataactagtacaccacacgtccagaataatggtatgtggtgaaactgatctgagcatcaccctgtcttattgtctcacctgataaaaattgaagtggaaggccgggagtatggctcacacctgtaatcccatcactttgggaggtagaggtgggtggatcacttgaggttagcagttcaagaccagcctgaccaacatggtgaaaccccgtctctactacaaatacaaaaattagccgagtgtggtggtgtgtgcttgtggtcccagctactttctgggcaggagaattgcctgaacctgggaggtgggaggttgcagtgagtcaagatcgcgccactgcactccagcctgggtgagagccagactctatctcaaaaaaaaaaaaaaaaaaaaaaaaaaaaggtagaatccatatgatcactaaacaacagtagtatctagacatggtttctgctacttaattttccctgagctgttgtctgcagaaggactgaaagcaccttgaactggtatgttgtacaatgacttattgaaaacttactgtgttaacttggcttttacactcctttgttgccattcatacttagcacacatataattatttacatttccccaaagggtcatattttttaacatctttatatctaatttttccttcatcctattacctccttgtctatctgataacattcttatcctccttcaagatgttgttcacataatttctataatgccttccataccaccctaatgaacatcaactccttcctttgcctgttaatgtgccttgaatatgattcttcttaatagttatactaaaatatttttatattcccagtgtcttatacagtgacatacacagaatatgttattaaatattttatgggtaaaggaaataattaacagatgagacagcactgtgaagacacctgatgaatattaaatatttaagaacagctctagagtaaggagatgtcgtgtgcaacgagatagggacaattattattacattgattctaaaaggatcagtaccttataaattacaaatacttcgtataccacaaagacagactacttaattgttttatagaattctcagattcaattctaagaagctagtaggcaggatccatgtccattattaagcaccagcatgccacaggtgtttagtaaatgtgtgttgagaagtcatgaagggggagaaaaggctgtgttttttactttatagattattagtgagaatagctgagtataacagtcattgacttactgtattcctatttatatttccaaaaatcataaattatgtttaatgactagcatatctagtcaaaaaagaagccaagcaataggacttagccaaaggaaatcccagcttcagcatactttttaaaatggcactgagagagtttaggtagcaagtagcgggaccagaggagaggggtttcagctgacttctcaacacacatttactaaacacttgcagcatgctggcgcttaataatggacatggatcctgcctactaggttcttagaactgaatctgagaaataagaaaatgtggtaaatgactaatagaataaagaatacagtgctgtaaaagatgtgacaaatacatagcaaatgaaaagaggggaaagggaatttgaaagtgtggtgggttatgaagggattgatgtagaaggagacacctcaaataggctctaaaggttagatgcataaccatatattcaagcccttatctactgattgtaagaatcagcgtagcacaggattaaaaacaccacatttagagccagaaagaacagagctgcaatcttgcttttcattattactaattgtaggaccttgactatatgacattacttttctgtgtctcaattttataatatgtaaaatgaggataataataatagtgccatctcattttattataagagttatgtgaaaaactatagaaaaatattacacaacctggcaaacaggcagcaacaaatgcatgtaagttattattatggttattattgttgtgattttagctatctggagacccacagagatgaactgatccctttactcattcttactgccatgaaaatatgatacttgaagttggggcagcattcatgtcaccatgggaaacagcaaagagaacaatataatgttggctcagctttcactgaaccttttaaccatactggcagcatcttactgccagactgcttgttatgtgagagctgtaatccatgtatcttaagtaatcgtttaacaggttttctttacctgcatcgccaaacactcctaactgatacattgatcatccaacaaggcaattttagagtgaataagacatagcaggcactgtaagacattatatgattttgataggtggaagtaatttcatatttgttctagatgataatatttcaaagacccactggatcccagattgaaaggaagccaagaacttcatacactcaaactgaaagcccatacctttcattcccaaaatatccatgaccatgacagaatccgggtttcctcattcataagatgaaagtaaagaataaatactttatagaactgttgtgaggattaaatacaatagtctatgaaaattttctttcatagtgcctggcagtagaaatcactcaggaattggtatccatttacattatgaaagcagcatattatcattccctagtgaattttcttgaaaaaattctcagttatttaatatgtaataaattagtctcttcattcgaagcatacattcttcctggatagggttcaaatgttacctttatttttagtcctttcccctcatccccagtgccacaaccaatcacagcccaactcagagaacatacttattttttgttttgttttatagaaacaggatctcactatgctgcctgggttagtctggaactcccggcctcaaatgatcctcccgcctcagctcccaaagttctgggattacaggtgtgagacaccacacccagtcacagaggacatgcttattgaaatgaacattttcaaactagctgtaggtccagaaccatcattatctctttgcatatggaggctgcttcacacttccattatatagatgcaaataacctgagagttgttaaacaattctataataccaagttgtccttggaagtcaacatttctaaaagctaaataggaaagcctcacctaagcttttccttgacatatgcatttggttcctgggtataatgaagagaaacttgcaaactgtgagataatttcatttaaatagctcattttgattataatttaagtggtgataataaggaagcatcctaagcaatggctttattagcataatttttggaagtcttgttaactctatgtgacagagttgaatataaattaatgaataatttagagataaaaagtttctgctataaattatatttccaggttctgaagttatgaagaataataattaaggtcacaggcacttggatcagatagacctaaatattcccagcctgtctctatttcctgtgggattttgagaaaaaattaatatctctaagcctcattgttcatttgtacagtgttgatgatcattgtatttacttaatagaattgtgataattaaattaaaaatgtatggaaaatgcattaaataaggctggcatacaataattgctcaagaaaaattgactagtcatcttgcgattttcaagtataatctatatctcagttaggctctccctacttcttaatttctgcattgcattagcttgaaccccacgttccatacttgagtttctctctaatattgctgacattatgaggaaggtcagttctcatagccatgtttcaatttggatttcagatctgccaaaggatcattctttgctattgtgggaatttccctttattacctcctggtattaattcaggtaaaaccaaatgtattcccctaattttcttatgtaactaatttaatccttataagaccctattgccaaagtaagcactaacatttactttttttttttttttttaaacaacccaaaactcattaattcactctgccaaacgactgggccaattccacctggtctctattcttcctctacttatctgataataatgatactaatgctatccacaacctccctccccaacacaaatatatgagagagcagtggggactgtgattaaatgataatgttgatttttgctttcttttctgcattttgaataaagaaaatgcaatttttgtataagtttttactgccttatatatgcacaagtttgagttgcagttaagcacccatgtaagactaaaagcacagatttccccttgcaaagacctgcttttggcctattcttggttataatttaagcagactgaatcgttttgcaaggggagcccatttgttcaaggaagaccatatttacagtcaaaattcatgtgttcttgttatgacttcagtatccttatcggtccaaagatagaactagtattttatctgtacaatagggtacttatgatggataagttagaaaatcaatgttagcacactttgtaaattataaaacacaatacatgagttacactaaattgaattgaggcaacatggcagaagagaagcaaacaaacaaacaaacctgggctctaaaatgaaaagacctcagtggctgacccaaacaagcctttttacgtccctttatttcactacctctcagaaatgaggcaaatgataataattaaaataatacatttttacaggtatcttataaaggttaagaaagataaatgctttttttttttgtcttattttgttcgtttttacaacattgtcggaaaggaaaaaaaaaaaacgtcaatccttattcctttctctgtttttttttcggctttagatggtaagaatattgtgtgacttttaaaccagaattcctgttagttttgttttgagagagatgccggcaaatctgctgcagttgacaggtggcagtgtcctggtcctgaggaacacaagggacaaggatgacctctgggctgttttgaaccaagggtcatgggtgatgaccgttttaagaaactactgcttccctctaatacattttcaactttatctgcttgatatcactgtcaggggactgctcaaagcattcaatatgtggaaggcttcctgctaggtatgcctcacagaggaggtattatatctggtttctgcagagcacaatgtagaaataaaatttgtcatcctgctgcccttttaagaaagaagaactgtaataattcccatttgtgttaattacctcatataatcaactgattaatttttgcaagaaaaattattgagtgtttataaggtaccaggtactgtgctagtccctggaattgcagcgataaaccccagaggtggtcttgggtcccaccttcatgttattcccaaataagggaatgatctgaggcttcagttttatatacccagtttaagcaagggacttgagattaataaatgtttactatggaaagaaagaaaagtaaggtctgaatcttgagatctcatggtatgcttagaagccattgtgttcttcattgggtggaacttaacaggggttgaatgggtaggaatgacaggagaggaacctgaagaatagacagaggccatagtagagtagacattcatgttatgggatatactttaaggatctatattatctaagggcactagaatcgtctctgatacactatactccctatttcttccaaggcatgtgaaattcaagaccagtcccagctcttataaataacattcttctcaggccattgctttagccagtgaactcacctcttgactgactatattagccatttgtttgaagacaacttcattcttcagtaggggaagacctaggccagcagcagctcttactctgcaaccctctgctaccctcttctggtggtagcctgtcactgcaattaacccttcaaatccaggtgaatctattctaagtgtggttggtaatggccaatttaggaaaagtgacatggggcagaaaacatagccagacccagctcctggctctagaaaaccaagtccattcacggaatctgacatcttaaggctatggcaagagacttcatgtggtgggccaggcaagcaggctgtatgaggccaggaacatgctaaattactctcatgcttccaataagagggtaggcatgtcaataacaatgaaaatattacttttcattcagcaatattagaaagcacaagcagcagcaggtaaaccagcacctcctcgtgtggcctttccttgtcatcttgcttaaaatatcttcaaatttctatgtccatccttgtttctcttttctctttaatgcattttttaccatctaacatgctatgtttattcaattttcttagttggctgtctatattattaaaaactaagctccaggaaaacatgttttgtttgttttttcttttgtcactgctatatcctcacttatattaggacctgacacccactagttgcccaatcaatacttttagaataaagagatatcagtaggaaacaaccctcattcatgggactgcaggtttgagaaaaaatctgcatagtaaaaatacaatgaggtctcccagtcctgctgcttagatagtgaggaccaggaataggacagtagatatgaattgggttgccagaactaagcccaaatatcatcagagttttggaaagtgtgattgttgggtttggctaaagttctcaaatgttaacagagcataagaataacctgggaggcttatttagatgaagattcctgaattcctacctccccaaattatagttcagtgggtctggatggacgttcaaaatctgaattcttaagcaccctcaaaataatacagaaggccctctgatgacacttttaggaaaataaaacccatcatagttcgaggttaaaattgtttttggaggttaagggagattgtgcaggtgggaattttgcttgtggaaaaaaaaaagaatggaggcagaaggtgaaaacaagtgaagcctaggggcgtcagatgatcattgcatgcccaatttcaatgcttaataaattgtactttctgcaattatattctcaaagattagattttaatatatagcaagtgattctgacaccaaaagcacagaagtcataccgtagaaatgctggcataaagggaagggaagggaaaatattttactttctattatgtatatgtgccagacactgtgccaagagaactttacaaagaggtgaatattattaaccttattttacagatgaaaaaacatgagaatcacacatgatataccacagaatcactgtgccaagacagctttacatggaggtaaatattaacattattttacagatgaaaaaacatgagcatcacacataatataactccctgaggtcacactgataaaatagaggtgaactgtgactcagataaaaggacccctgaatctattcccttaggttattctattacgtacaatgattgtcctgcagcacacacattaagatttgttgaacagataaatgtgaggatgatttagtgaacaaatgaataagtgatagcatagtcagtgttaaaataggtgaatgtgagaaagctgatagtgaccacatggtatcattctgaaccaagacattcatttgaatcactaatatagtaatctgatgtgattaatcaatactaggttttaggcaattcatatttcttcattgacatattttgcagatgaggtcaagtttattgatgttcaatgtgcacagagtatatactcttttaaataatttagttacataaatttggccaactgtatgaggttttgtaacccctaccatagtcaagacatagaatcttccctggtttaattttggaattactcttccccgaccactagctcttaccaaaacaacaaaaaaaaatctgattctacccttataatttcaactttatatcttatcttacagattcatcactaattattttagggttttgatggtactgcaaacatttttaaaattttaatttaaaattgtttcttgctagtactacagccttgaaagtgattgccatcctaaattttgtgtgctaagcacctcttttgacttctcttaataacactgtggatagtgtaaaaaaatacaactacattttgtatgttaactttctgttctgtgattttgttaaactgattagttctagtagcttttgaggggtgtattttgtgggaatttttacatagactatcatgacatctataaatactcatttattcctttcaaattcatatacattgtctttatcttgtcatattgttttagtaatgatctatctccagtacaatattaaagagattttagaaagaaaaaatatttttgacttgtttctgattttcaagagagaaaacatttaattcttcactcttatgtgagttttttcaaagatacactttaatagtttgagaaaattctcttcaattcttactgtcgtgcaagtttttattacgaatacattttgaatttttgtcaaatatttgtgtaggtcagttgagataattattacttttttgtattttgtttatatacttaattaaattactctccagtaatttaatctccactgacataatgctggatttataaaattaaacttatttaataatgatatcttacacttttgaaaatatatggctggattcaatttgtaatgatataccaggcaaatatcagccaaattataatcaaattgatttcggaataagagacaaaggtggttatgtggttatgatgggttaaattcaataagaatatgtaataatccaaaatgggtatgcaaagaataacagggttcaaaatacaaaaagaaatagctaatagaataaatagaaaatacacaattatatttgtagagttctatgcttctctcaaaataattgataaaataattagaaaaacatttgtaaggatataggcgatctgcactaagctatcagccaacttgacctaattgttatttatagaacattatagccaacaaaacatataaagcattatttcacatgtgcacagaacacatcaagatatatatcctggacctataaaatattaataaaatgattataatcatgtatgcacatcaagcacaatggaactaaattgaaataaaggaagaaatgagaaaatcttcaaatatttggaaatgtaagtaacacatggataagaaagaaatctcaagggaaattttaaaatataaatgaaataaatggaaagaaaagtacaatatattaaaatgctagatacaacttaaagataaatttatagcactaaatattaatattagaggggaataaagcaatgaatcaatggtctaagccttcaatttaaggaactagaataagaagagtaagctctaaataaagagagaaaaaatataagggaataaattaatgaaatagaaatcagtacaataagaataggaaactaaaaacaatcgagaaaaggtgacactgaaagctgtttcttcaaaaagagcaataaaattaatctctgttcaaaaggatcaataaaaagtacaaattaccaatattaggaaaaaaagacactgcatatattaaagggacaatatattatatgaaaagacaaaaaatctaaatagccaaacaattttaataatttttattatagtaaaacacataactgaattcaacattgcaaccatttttaagtgtatagtacagcagtgttaactatatgcacactgttgtgcgacatatttctagaatttatttttattttgcaaaactgaaaatatatacccattgaacaactcttcctttcccctcccccagcttctggcaaacaccattatactttctgtttttaagagttttactacgttagatatgtcttgtaaattgaaacatgaaatatttgtcttttgtgactggtttattttgcttggcataatgtcctcaagctttattcatgttgtagtatgtgacaggatttccttattttaatgctgaatattccattgttgatgagcattgagacagctttcacctcttggctaatgtgaacactgcagagtaaacattggtgtgaaaatatttcttccagacccagttattaattattttgggtacataccccgaagtgagattgctggattgtatggtagttctatttttaattttttgaggaacttttatactgttttccgaagtgctgtaccattttacatgaccaccagtactataaaagaatccaatttgtctgcatcctttttgatccttgttattttctggtctctgtttctgttttttatagttaccatgctaattgatataaggtggtaactcattgtggttttgatttgcatttccctgatgattcgtgatgttgagcatcctttcctatagtgattggccatttctacatctttggataaatttatatttaagtcctttgcctatttttccatcaagttatttgttttgttgctgtcattgttactgaattgtaggtgttgtttttatattctgaatattaacgccttatcagatatatgctttgtaaatatttttacagattccataggcttttttagttagctgattgttttctttttggtagagaagttttaaaatttgatgtagttcagtttgttaatttgttcattgttgcagtgcttttaatgtaatttccaagaaatcatgccaagtccaacgtaataaagttttttcctaaattttattctaggagttttatagtttcaagtcttatgtttaggtttttaatccattttgagttaactttggtacattatataaggtaagggttcaacttcattctttcatatgtagacacccagttttctgataccatttgaaaaagagactctccttttcacattgtgtaaccctggcatccttttcaaagatcaattgaccatatatgtgtgggtttattttggggctctctattctgttccattggtctatatttgagtctttatagcagtaccatgtttttgttactgtagatttatgatatgttttgaaaccagaaagtatgagatctctagctttgtttttctttctcaagattgtattgggtatttggggtccttggaattctatgtgaattttaggatttctattctaagaaaaaggtgccatagagattttaataggaattgtattgaacctgtagatcactttgggtagtatgaatattttaacaataatgattattctaattcatgaacatttcattgtatttatttacatctttaattttttcatcaatattttgtagtctgtagtgtgcaagtctttcaccttcttggttagtttattcctaagtaatttactctttttgatactattgtgaacaaaattgctttctcaatatccttttgtgaattgttcctcatgagtatatgaaattgattttgtatctttcaactttgctgaatttattaattttactacgtttttttgtggaatctttagtattttctacaagtaagattatttcaactataaagagatataattttgctttttcctttccaatttggatggctttaatttcattttcttgcctgattgtttcagctaggacttccagtaccatgttgaacagaaatcacaaaagtaggtattcttgccttctttctcatcttggagcaatagctttttgttttaactgttgaaaatgatgttaattgtgggtttttcctatatggcctttactgagaaaatttccttctatttttagttttttgagtgtttttattatgaaagtatgctgcattttgtaaaatgctattttttaacatcaataagatgatcatgtggttcttccccccattattatgtctctttttacagtttttgtaacagcctgttttatctaatttaagcattgttggtcctgctcacttttggtctccatttatttggaatatctttttccatccctttactttcagtctacatgtatcttcaaggataaagtgagtctcctataagcagcatatagttgtgtcttattatatccatttaatctaaatcttttaattgaagaacttaatcaatttacttcaatgttattattgatcagtaaaaacatattcctgccattttgttaattattttctggttctgtcatagattatttattccattcttcctctcttattgtttttgtctgtggtttggtggttatttgttgtgctaaactttattttccttcttatatgtatatctgttgtaatttttttctttatacttatcatgaagctaaagtcttgtagttacaatagactatttttaactaataaaaattttactttggccacataaaaataccatttaaattttcttcctcacactccacaatttgtatttttgttgccttcatttacatctttatctactatgggttccttagccactaattgtagctattgtttttgatcattttgactataaaccatgatactagaggaatacaagatttacatggctcattacagcactagggtgttctgagtttgattttgaacttatctctacttgtgagctttatactttcacatgttttcatgatagtaattaccatcctttcatttttggttgtagcactcccttaagcattttgtgtaagaccagtatagtggtaatgaatttcctaagattttgcttgtctaggaaggtgtttatttccctttcatttttgaagactagctttgctgaatataggttcttgagtaccatgcattttcttttgccaatttgaatatatctccctattctttactagcctgcaattttatgcttgcagaaatctgctgacagagtaataagaatttgctgatatgtaactagatgcttttctcttgcagcttctagaattctttgtttacaacttttttaaaaagttgtttttaattgaaacataatagttatatgtgtttatggggtagagagtaatattttgatacatgaatacaataggtggtgatcaagtcagggtaattagtatatccatcatctcaaacattgtgtgtgtgtgtgtctgtgttgagaacattgaacaacctctctttcagctatttgacaaatataataaatcattattaactatagttaccttatggtgctatagaacctgagaatgtatttctcctatctacgtgtaactttatatgtattaatcacctctccctatcctcccctttcttttacttttctcagcctctaataaccataaatctattttctacttctatgagcacaacttgactgcagcactattcacaatatccatgacataaaatcaacctaagtgtccatcaacaaacgaatatacaaagaaaatgttacacacacacacacacacacacacacaatggaacactatatatagagatatatacacacacacacaaacacacacacacacaatggaacactatatctggagatatatacacacacacacacacaaaggaacactatccaccataagatgaattaaatgctataatttgcagcagcataaatgagcctggatgatattatgctaagtgaaataagacacagaaagaaaaatactgcatgtttcactcatatgtgggagctaaaatttgtctttgacaaatgacattttgattataacgtggcttagagagaatctttttacactgagtctaattggggaatttttagcttcctggatttggatgtccatatctcgctcaagtattgggaagctttcagtcattattgtgtaaaataggttttctgtgcctccttcaataatatgatgctccaaatatttgttcatgtaacgatgtttcgtaagtcctgtagtatctctttattctcttttatttctatatttttctgactttgttatttcaaaggacttgtttccatgttcagaaattccttcttttgtttgagctagtcttttgttgaaactctcagttgtgttttttatttcattcattgaattattcagctctaagatttctgcttggttcttttatatgatacttatcttattgttgaacttctcattcatatcacgaattattttcttgaattaattgaattgtttgtctgtattttgttgtatcctgagttcttgtaagatcattatttttatttcctgttaaggcatttcatacttttttttttttggaatctgtttctgaagacttatgttcctttggggtgtcaaatttctttgtctttttaagtgtctggtgcccgtgtgttgatatctgcaaatctagtagaacattcatttttcccctattttatgagtacttttgtaagaaaagacttttccctgaagatggatcctaggacgtcagttgggtatggtgcattgcctttagctgtggatggattctgtagtatgatctccatgcagttacttcagttgaaatccttgtccatgatatctgttattgcctctgtggtctaggctataggagtctgtgatggtggtggtgtggtattgcttgaggttgtgtctctgggctggtcatgttgggtgcatatgagcacagtgtgccaacaggctgtgtggtgggctctctggaggactgggctgtcaccacattggctgttggattaggcacaggcatagacacaagcatttttcttgaaatggagagaaaagtgaggtgttgcctgtaatcccagcactttgggaggccgaggcaggcagatcacaaggtcaagagatcgagaccatcctggccaacacggtgaaacgccatctctactaaaaatacaaaaattaactaggcatggtggcatgtgtctgtagtcccagctactcaggaggctgaggcaggagaatcgcttgaacccaggcggtggaggttgcagtgagccgagatcacaccattctacgtcagcctggtgacacagcaagactccatctcaaaaaaaaaaaaaaaaaaaaaaagaaaaagaaaagtgagatgttatcttccttaagatctagtaaagagtgtcccaggagaatctctaattaagaatgggttggtttatgaaaagaggatattggtatcttattaactacctgagtagtggtgattgaaaaacaaattatctggcctgtcagtctggggcatggtgagataatttttgagggagcttgacttaaagtttaggtatacatatgaagatagatatatttggtatctatttttagtataggcatatcttaaatctagagccttctagagcaacctaggccagcagaactctaagataaaatatggtgtctgaagaaaatatggtggtgaccctacaacattttaattctctgatgatcttggaagtgcagaagcaggctccagtgttccaatagctccacataaagttaatgaaagttagctgggaggcgtaatttaggaagcatcctagccagctgaatggtcaagcaataaattgcccaacctagagaagtggttgacagcatatatctttggtgacattgttgaggagcttggctgtattgtatgagtgggttcttgaagagagataactaaatgaatctggataccatcagaaaactaggctcatcaataatacagaatccaacatacccctggagcatctgagcatcaaattgagtaaggtcaggggtaccttctctatactaccatatcagcagccacaaaagaggattatttttctctcaattcttcttctttgcctcagtggtaaagtaacgagaaactaggatagtgagaaaacatgaaggacgtttaaaggcaaagtcatctacttctgttccaggtgctaaatcagggaaaaatgttcaaagaataaatcaaccatctttgtcctctactattcttcaaatttcaagttttttctgaatagaatggagagaatgaggattctgataagaaactatgttttatactgaaaagaaatgtcttaagaaaccagtgtaaacaaagtaattatgtatttaacataagcttccttgaagggttctgccaccttattgggaagcaataattttaataaataacataacacattgggaaacataacacattaagaagcaataattttaataaatatgtgtttatattaatacttcaaatattggaagttctccaagaaaccagtggtactatttttatgttattgtttaccttgaagctaaacttttggatgtgtatactgagaactttgaggagaaataatttatatgcaacttagctaagcagtttaaacatgaaaaatgtattaaccgtagttcacttaaatggttaaaccataaaggaggacacaggataccttgattatacttccaaggtgttggtattagattgtttcagataattgcacctgcatcttatttatcctgacagggcacagattattcttttgcctaggttgataaactgaactgcacctttattcacagtatgacctattccttcagcagagtctagacattttgtggcaatatttcagtgctgcttacttatacatatttggtagtttctttgagtggactaaatctccctttttagtccttgcactcgtactccttatctgaaaaaggaacaaaatacttgttgaaatctacttggtcaccttattctgagggtctagtcgtatgacctgtctttccatcttctctcagtaatttataggaaagtccctatccatataatctgtcagataattcttagacaaaatttagacatttcatctctgatgaccactaggtagaagctcccctactgtcatgttggtttcataaatatcagtgttcatgctgtgtgtgggccgattcagagcttccatacacctacagttctatgctaaaaataagaggaaatcatttgtttcctaggcaacaatttcatggaacatgtatagttctcctttgaaggtgtcctaaatggtgaagtttagtatttgcaatattaacatgttcagttttttaaaaaactattaataatttgctttaacaatcatagattgctaaattaggcaactattaataaatgttgactaagttcaaacttgtgcacaaggagggctaggtgttctctctgtataaactctacatagaatatataaaaggggatagggaataagaacagaaggaaggaagaaaggaaggaagagagagaaaacaagagaaaaagaatctacaaataaacaccaaacccacaggaagattttcagattaaaacaaaatgcttagcatgatgattggtaggtattatatgttcagtccatggtagcttttaaattttgttaaaataaaaacaatcatttctgtgtaaaatacttaggaaagcactggagtgttaaatgtatcatgaaatataagttcagtgtttattataatcaggccgaagataacaatgaaggcaagacattgatcaggaaaggcaaattcttcttttgttggcttaaatttatattaatatgtacagatatacagcctatgtaaattatacccacatttgcaaactatttagcacctcctatgtagaaggttttatatagagtattcatatgcattagctctttaaattctgagaactctaaaagaaagctatcattgttgatattttaaagatatgaaacagatgctcagagattttaagtgatcatctcaagtttgcacaactagtaaatctaggatctggaattcaaattaggtcagatccttgatgttcaaccacacactaatccagaggtctttgttctttccctaggaaagtagatctaatgtttccataaaagcaaaaagtagctaacagaacttgacaaaaagatgtttagataaatcaagctataatttatctaatagagaaaggaatcaaaaacatctgatgccccaggctatgagtaggacataagtcaaaattataaattattttgttactgctttttctccagagaattttagagctaggttaaaaacacagtttgataaatacatctaatagtgattcatagtattattatttcaaacctgaaactttcctggactcatacagatgcctaagaaacacagctgctacagaataagttcattgagtactcctggggaaagccatatcctgtcccttttatttcttccttcatctcaagtctctttaaaaataagccccagaaaatgatccattaaaacaagacatgaaaaatagctcttaagtgaattaaaacttaacattcagttagttgtataaaactgtaaaattatttcattacatttacaataggctttcttattttgatatacttgcaaattttacaggaaaaagcttataataaattttagctgttgtcttgatttatttttaaggtgtccaaacctaattgttcttgtcaattaaaagtatattttcttttatttttctagagttgggtgtcctcctcctacaggttggtgacattgtgaatgttttcagttaacaactggcttggacacaggcattcaactggttcaacttctccagcttactctcttagataacagaagtaaatgtctcagtttcctttgtcagtttatacacagacgattagggtcatgctgacaaataagatgctctgggagtttcagttgatttgattctgagactgaaaatacttttgctgaaattgattgaatatttatgccctgttaacagtggtttggccacattactttgtgtgaggtattgtgagggcaaacacagatcaagagagataaacttgaaagagttatagagttttgttactcatagttccctagggagaacacagcatgccatgcagcgtcactcaagaggagataccgggactggtgtaaaatacacacacacacacacacacacacacacacaaatatacacacatacatactaaaatatatatacacatatgtgtacatacatatacatgtaaacgtgtgtatgtatatacacatacacatgtatgtatacatatacacatgcatgcatatatacatatacacatatatgtatatatgtatgtaaataaaatatgtaaaattatataaagttttctttgtttctatttaaattctttagacctccttcttcattattgtgagaaataattcattttgttaagggaacaaagacaaccagttccattcttcatttttcctgctactgagactcagccagccaaaccaatatccttgccatctctcacaaagagcttatgctttctccgtgcacatacaaatatctctctgctctttccaagtcacattttgctgctccttcagaaagtaaagaataattttatgaaaaattttatgccactctgatctagtaattagatctgtaatttattactctgtaccatttggatgcttgtgtaggcttcacaatcctcagattggagcttactcagagtagatatgtaataagtgtttgttgaatggtttcaactctacttcacgcaagtgccctgtggatacccaatcatgaatattttgagggtaaaaccctaactgtgtggtttgtctcacatgacttagtccaaaactgtatagttgatggctacctcatttatttaactctatattggattgtgacagatataataatatattgatactatgatatattaaccagggtcatgtctagcaagagaaacatatataaagaaatgacaatacacattcttatttcatttcaattgaaagagttgcagaagtaacaaatagaatgtaattagtgtatattaacatggagatctaacttggcctgaagagctatggtttccctgataaagtaatcatttaagctgagatctgaaggataagtgggaaggagtcagtaaatattttcactttacttcagttttgttcaccaaatttctaaatatgatttcaatttatggacattcacatgattatctattaggtaaatcgacctggggcatcagatggtttttaaattaaaaatgtgactctagaatgaaaactagaatgctatgcaggaacacaatgtttgtattctaaatttcttattatttccaaaaaactttcatccaaagactacatgtaattatttatttgccttgttttgtaggcaatagaaaagaattttggaaaagttagcaacatccatagtagtgttacattgatgactatgatatgctagtcctgaagttgttaagcttataaatttacagttggttttcaaagaagtagttaagtaataaatatttattttattgcacattgtctaaatatgaacatctgcattgtaatcagttacatcatatgtactaatagggactgctgtttatgatagtcattgtgtatgtcctatgggtactctcttgagattcacataagataatgaacgtgaaagagccatggaaaggataaagcattaggcaaataacatgttatatatttgtgacattcttttccagttttcctgttgtttaaatgtaaaaacataagaattttaaagtgtttcaagagaatactttaatgatggatcaaagttaacaagaagaaaagaaagaaagaagataaaagataaaactccaaataagatagtttgaaaaaataatcagcgatgcacaacttaaagattctattaaagttatgagtagcagagtaaaattgtttggataactcaaaaatgtaaatgtaaccaatatcactgaacatttaaaaatggttaaaatgatacattttatgttatgcataccttaccacaatataaaaagataaaatgttaataatattttattactgcattaaaatgcattaatatttttatcattatgcatactttaccacaaaacatttttaaaaagcttaataaacagattctagaaacatattagaagtataacaaatcattaccagctacagttttccaggaataaaacaatgttttattattgggtaacctattaacaaatttccctaggaatgacaaatcacaataatctcaaaaaagtttataaaaaatgtcagaatttaacatttattttgtacaaaatagcaacagttagagatatattacgcttattggaaaacagcattctcattaaagccagaaacaaaacaaggaaactctttattaccaccactatatagtattgtctgtgagttataagacaatacaattagataaaggaaaataagaggtataaaaattagaaaggatatgaaattattctctggagatcttgtaattgtttactgtaaaacaaaattttttcaaaacttagtagagtcaaaaatatttataaaggataaaataattaagctgaaaattaatttataaaaaccaattagtttaaaacaaagaacactacaaaaatatcatgaaggtaaattcccatttcaaataaatgttaaaaggtagtaaatataacgagcacaggaggactcaataaagaaaattttagaggacaaaagggatacaaaagaaggtgttgagtgcaaataatgatttgaaataagaggtgttaaaatataaagacagcgattctccctaaattgtttaacatttaacaccatgtcaacaaaaatgctttgagatttacttagtagcttggggtgtagggaaacattttttttttttgtaaagtaaacaatcagtaaaaaccaagattttattttttttttaaataaaaagatacatactgaggagagaatagccttattagatgttgtattagtcagggttctctagaggacagaattaatggaatatatatatgtgtgtgtatatatatatgtatacacattctatttatatatatatattctattatatatatatacttataaattcctattttttctatttcccacaaaattcttttctatttcctacaaaacaaggcaaataaataattacacgtagtctatatatattataggagtttattaagtattaactcatatgatcacagggtcccacgataggccatctgcaggctgaggagcaaggagaggtattccaggttccaaaactagagaacagagtctgacgttcaagggcaggaagcatccagcacaagagaaatgtaggccaggaggctaggcagtctctcatttcacacttttctgcctgtttatattctagccatgctgacagctgattagatggtgcccacccagattaagggtgggtctgcctttcccagcccactgactcaaatgtcaatttcctttggcaacaccctcacaaacacacccaggatcagtagtttgtatccttcagtctgatcaagttgacactcagtattaaccatcacagatattatatcagaaaactgtaatagtttatactgtatgatataaacaaacagatcaatggaccagaatataaagtctagaagagtagtgagtaactagaacattagtaaagacttagcactttagggatggataattcttttttgtcagatgctgtctggtacattgtaggatttaacaacatccatggcctttacccaaaaatgacaatatctctccctagttgtgacaatcaaaaacatctccagagactgccaaatgtccccaaaggcgcaaagttgccgttatttaatacctactgatataaaaatatatccaaatataattggctatttatatacaataaacacaatcttcaaattagtagagaaaaaatagtttatttaattttatggttggtaaaagtggatagaattctggaataaatcaaaatagatctatacctcacactttagaacaaaataaattctgataactcacacaatgaaatggaaatagacatgaaatataaactataaaagtcttagaagaaaataaacaatttgattattcaaaatagtatttctaaataggaacaaaactcagaagtcattagaaaagattgacaggtttgatccctgaaaaatttttaaaaatctcattttatcaacaagataaagtcaagagataaatgggaaactagaaaaataatttcaacttgaatcacaaggagttactttccttgttaggaaaaaattacaaatcaataaagaaaacaggatgaactcaaaacaaaaagtagtaaagattaggagtggttgacagaaaaattatagctgtttcttaagcatatgaaataatattttgacatatttataaaaaaatgcaaattaagatcatattgatatataatctttcttatgtcctgttggccaagatcacatgtgtgatgacatgctgcattggtgggtgtatgaggaagtagctgatcttgaaagatggatatgtagttattaggaaaagaaggagataaaattatgagcatttcaaaaccaagtaattcctgttgatgtgtaaattaaaacaagtacaaaggaaggaattttgaaaatatacttcaaaacaacaactgaaaataccatttggacatattctagaacatattcacagttgtgcaaaatgatatgtttaataacggtatttgttatattattgataatacaaaaattctggaatcaccttgtttataggcactggtaaaacattacagtacatcacttcaaaggaatgctgtacattcatgaaaccactatagttgtactgaaaaataaaaaaataaggtgtagaacagtgtgcttaatatgctatactcaatttatataaaaataaagaacacataaacatttcagatacatctgaaaggacataagaaaacaggaggtatacttacttttactcattaatgtattatatattttaaatgatatatcatgtgcatgtataagatattcacaatgagtaaatacaatttttaaatgcattaaggacatagtgacaaagcatccacagtcagcacacaggtatattctacgtgactgcctctgttgactattgaatggaattacctgtcatagaatcatatgttaccaatggaggtgtcacaattttagcctgggttcagcagtaggaagggactggctagaattagttttggcatcttacacctactactgggctacttaaagggcaaactcatcacaagtgttgcaggagcatgaaaaacatgcactactttaaaaaagattttctgttttattcttgctatttgaaaataaatatcgaagcatctatcatggggataaatcaaaatattgtaacactttttggaactttttaaaagataattttaaattttctttgaatttttatgggggtgaaccttaagcattttctttctttcttttgtttgtttgtttgcttgtttgttttgagtggggagatttaggaccattattcatcctaaaataaatctgtcctggtgtccaatagatctcatttactatgtaacattattttcctacacctttatgtcacactaaccatatactacccacactgccatttcttgctaggattgaatgttacgaacctcagcacacctttctcataatgaaaatggcataacctgggcctgatcatttccactaggggaaaacaggtatttgctactctttagggccctggcaggtcacgcactagaatgcctccatctatctgacttcaagaatcatcagccaccccgatgccattgttatgtatgtaccaggctgcttctcagagatggtgatgcccattcgaacccagtataactttgctaccctgttttgcatactgtgagcagagattctggttgcatttcttccttgaaggaagctctacaacttaagttattttccatagtccctgtaagtttgtgtcttaactgagataatccccagtagaccaaccgttagacaaagtgaatttgaagcagagaggataaagaataactaagggggtgagaagttattcactcatttattctaaaaatattattacatactaactcagtatcaggcattgtgctaagtgctagaaatactgagatgtgtaaggctgagttgctgttcttagatactcaaatattattagggtaactttcatcaaaattactttcaaaatttcatagaaactgccggaggcttcatgtgctaatgctttcatgcatcttaaaaaattcatcaatagctacgttgtattagtctgggtgttgctttttgatggttcttctttgatatctactgtaattaattaccacaggatgtaggctctttgatttcacaattcagcttaaagaggaaaaagggccttttcaaaacacctgaaagaattttaccgtggccctccactataatcccactcttgtatgccagttatatgtttttgacttcagtatatgtagcttcatattgtactatggctttctaacatttgacctcgagatcttaaatttgtgtcttgtgaatgcgtccaaagtgcttgtaatctgctctcatgtagcaactggacataatcttggcacccatcagatcatattaccactgttttccccgcaaagactcgcagttaaatttgaatttcagtaaaacagccttatttttagtgtaagaatgtcccatgaaatctttggggcacagagttatgcaattttcattatgaatgtatcctttaaaaaattcgttaatctgaaattcaaatttaacagcttcctgtattttatctgaaaactctactttaaagatgtatcatagcctgaagattctataattttatctttaaatagcacttaataataaaggacatgatttagtccatagcaatcagaatttaaaaaaattaatcaacccttttatcaagtattgtagtctgggttatattcttatatctatatctacatacatatatattttatatatatattatgtatgtatacatgtaatgcgctgctaatttttttctgttagctaaaagtttttctttttttttaaattatactttaagttctagggcgcatgtgcacaacatgaaggtttcttacatatgtatacatgtgccatgttggtgtgctgcacccattaactcgtcatttacattaggtatgtctcctaatgctatccctccccactcccctcaccccatgacatgccccggtgtgtggtgttccccaccctgtgtccaagtgttctcattgttcagttcccacctatgagcgagaatatgcggtgtttggttttctgtccttgtgatagtttgctcagaatcatggtttccagcttcatccatgtccctacaaaggacatgaactcatccttttttatggctgcacagtattccatggtgtatatgtgccacattttcttaatccagtctgtcattgatggacatttgggttggttccaagtctttgctattgcaaatagtgctgcaataaacatacatgtgcatttgtcttcatagcagcctcatttatactcctttgggtatatacccagtaatgggatggctgggtcaaatggtatttctagttctagatccttgaggaatcaccacactgttttccacaatggttgaactagtttacagtcccaccaacagtgtaaaagtgtttctatttctccacatcctttccagcacctgttgtttcctgaatttttaatgattgccattctagctggtgtgagatggtacctcattgtggttttgatttgcatttctctgatggccagtgatgatgagcattttttcatgtgtctattttgagaagtgtctgttcatatccttcgcccactttttgatggggttgtttgattttgtcttgtaaatttgtttaagttcattgtagattctggatattagccctttgtcagatgggtagattgcaaaaattttctcccattatgtaggttgcctgttcactctgaatgactttgacgagttgagaggagaaggcttcagaagattgataataacaaacttctccgagctaaaggaggatgttcaaacccatcacaaagaagttaaaaaccttgaaaaaagattagatgaatggctaactagaatagacagcatagagaagacgttaaatgacctgatggagctgaaaaccatggcacgagaactatgtgacgaatgcacaagcttcagtagctgattcgatcaactggaagaaagggtatcagtgattgaagatcaaatgaatgaaatgaagcaagaagagaagtttagagaaaaaagagtaaaaagaaatgaacaaagcctccaagaaatatgggactatgtgaaaagaccaaatgtacgtcttattggtgtacctgaaagtgacggggagaatggaaccaagttggaaaacactcttcaggatgttatccaggagaacttctccaacctaggaagacaggccaacattcaaattcactacaaaacactacaagccagaagagagagggggcgaatattcaaccttcttaaagaaaagaattttcaacccagaatttcatatctagccaaactaagcttcataagtgaaggagaaataaaatcctttacagacaagcaaatgctgagagattttgtcaccaccgggcctgccttacaagagctcctgaaggaagcactaaacatggaaaggaacaaccggtaccagccactgcaaaaacatgccaaattgtaaagaccatcgatgctaagaaaaactgcatcaactaacgagcaaaataaccagctaacatcataatgacaggatcaaattcacacataacaatattaaccttaaatgtaaatgggttaaatgctccaattaaaagacacagactggcaaattggataaagagtcaagacccatcagtgtgctgtattcaggagacccatctcatgtgctgagacacacataggctcaaaataaagggatggaggaagatctaccaagcaaatggaaaacaaaaaaaaagcaggggttgcaatcctagtctctgctgttaatttttttaaccataaatctgaataggtcttcatttcaatttttttcttgtgaattaatgagttattgaagtaaatgaaaggcaactttaaggatgtcaattcatgtattcattcagtaaatatttattaagtggctaaaatgtggcagacatgttctaagcagagatggtgacatgatagaaaaaaatgaactttcataaagataaaattggccatatgttcatagaaataaaaagaaatcattaaaataaatagtaaatgactatatactgtgaaattgtgtgattatagaaatttgtgggactttgggacaaaatcgacctgattcatactttaaggaagggaatttgtcaagatatatgagtgaggtggagattattaagcttatatcaggaagccactagtgtttactgttatatattaattcaatgtattatttacttttgctaattggaaattgattactgtgatacaagatatataatgatcaaatagaaaaataataaggttaaaattttgaactaataattatggatctgacaaaattgaatgctcacatttagatagcacatgtttctggttgaataggccaaggtttctagggaactttctgaattgtatttttcagattatttaatgaaggagagtaatatttagactttgtttcatataaaaatcaaaagcagttattggttattaactaatcccccaatagcaaaacttatgctccaaatatgtttctgttttcttgctagctcttgattagtttacagagtccatgtttccatgaaagatggaaatctaagtttataaccatttactcaggaataaatacaaggctatattattctatctatatatctctaaatatttaatttatggtgctcaatacctcttgttcatttctcttccttctaatgagccattgatagtttatacctaacttaaaggtatttaagttaaagacaattttctttggattgcttcaggaatggaggaaagattctgaaaacaagtgttgagagaaaatcaatttttcttatttaaaaggctcatgaaaacggtcactatggaaacaagacatgagtccatggaacatcaagagatcagaagagaggtcttgagctgagactctcagtcttaaatttggaaatttgacataaattttaatcctcatttgatgataacttctttataaattctgaggttttagattacatagcccttggatttttaagtttctgcataattctctgtggcatttgttttctcttcttcttccttcttaccttccttcctgtcttcttcccacactttattctcacactctctcttttttcttctttccttcctccctccctcccttcctccctccctccctttcttccatatctcctatttaaatgtttttttctcctctttcttcttttcctgccattgttcttcattgttttgagtgacaatgtgacatgcaaaaagaaaggagatgacagaaaactttcttgcctttccttttttatttttccaacttcttatttttttatttttatttatttaatttttgaaatttcgtatttcttgacctaaaatattatagtattctgtctctgtttgcatacagtgaagatgcttatgaaatattgtctaaagatttccattcatagtaacagtggtcagcttctggatatgtgcagaaaccagtgttaatgagagaaaaaagttagaaaggttttttttgtttgtttgtttatattaacaaaaatacatttaaccacttggtctttggaggatgtaggatggagggaggccatctattagtattcagggaaaaggacaggtatattgcttctaatttttcctttgaggttgtttgccagactaattaatgttagaggtagcaagggggtaatagccctaatagagaactccccataatggatgggggctaccaccattactgacctcagtcaattgacctaggcctctagtcatttctctagaaatgagataatatacaccttctctcaaaatcacattcagaaaggttttttatagcaacctagttattgtcattctttagaaataaagcactttcagttcaattcacagggtgacttggctagtagagagttccagccacattcccttccggagttctatgatctacagataagcctacaaatctcttggcttttctacactaaaaatattactaagaagtggggaaagcaatacattctattaaaaatagaagtgtgagcaataattggaaaatggattgcttaaatattctatgtagttcagagtaaactcataaataggtatgagcttaaatgtaaattttttaaattttaacacttgcttgaggatgtccttatatatgaataaaatcgaaaaatatgtagttgaaaataatcattagccactgtatttacaaatataggaaataatttagaaaacaatttcaagtaaaacaaaagctaggattttgtgtataacatatatgcaactagactttcagaaccttgaggttattgctctttgtaacctctatacatagcacagggtgtagcatataacaactgctcaattaatatttacttaagaagtacatggatgcacagaagtacaaatatatattaacagttgaaaacaaaatgcgaaaaatattcacttaagtttgaatttactggacaataaatatttgtcatcctatttgttttcacataaaatattgaataaattatcttgtaatattttgaacattttaattcccaatatatttttatataatgaattgctaatatgacttttcttttaaaaatttttctagaaatgctgtaatgtctacttgagattttataacaaaaatattttattctggtacatgtgaattaagtatgtcaatattcaagatttacacagtttaagagtcaatgggaaagagtgtttacagagttaggatgcagcataagataactggaaatagcacaagtttggggttctaggatatgattttacatattggagttgctattttaaaattgtatgctaggcagggtgtggtgcctcatatctgtaatctcagcattttgggaggctgtggtaggagaatcacttgaggccaagcgttcaagaacagcgtgggcaacatagcaagacaccattgctacaaaaaaataaataaaattagccaggtgtggggattcacatatgtagtcctagctactggagaggctgagacaggaggatttcttaatcccaggagttcgaagttacagtaagctgtgattgccactgcatagcctaagcaacagaacaagaaactgcctcttaaaaaaaatatggtaagtgctaacaacttcacctctttgggtctcatcagttacttcccatagttgatacgaagaatatttgagagatatgtctatttttgacataaagtatgccttaaaatttttacaaatctgaaatgggggtatccattggaaaaaaaattctcattctcagaaggggtaaacagggcattaatcatatagaagctcatttattctcatgttgacaaattgtgctttacttgataaaatggcaactacactcatatctatgtcatttgtaccaaattaatttaaaataaacacaaaggatgtaaaaaagactgaagagtggttctgaatcttggcagtacattagcaccatctgtgaaactctttaaacattccttgaggcctcacctgatatcaagtaagtcagtgggtttaaaagatctcccacgtgattctaacatgtagccaaagttcagaatccctgcactaaaaagtctatgtatctgaattactttatgctactttagaatctagcttgcgaaaatctggattaattgctagaacacattaatttgtttgttagaagtgtgtttggtaaccactacatgctagacacaatagccagtacagagaatgcataaaataaaatgcctaagaagagtttgcattatataaggcaacctgatgaggcaggaacctaatgaataatcgccatatcatatgatacactagggctttttagcaaagttttatggtagctgaaagacatggtgtccagtctttcaagggagttgggcaggcagtgtttcactggagttaatcttgaagggtaaacatgcattcattagagggaaaaaaaggagattaatattaaatgtctttcaaaacaataaagagtcatgataaaagggaaaaaggggaattagagattagtgagaacttctactctttctgaatattctgaagatattcattccaatataaggtttagaaagcccagtgtttcctagttcctgggacttgaattatcaggttcaatttgattataggactcatttaagttgaatgatgcctggatctaaagtgcttactaaattattataagctaataataactaacattgtatgattactattagcaaggcactgttctgatggcttagcaggagttaacagttaatactaacaatggctttatgaagtagttgtcactaatctttctctctacttataaataaataaactaaggtacagaaagcttaaacagtcaatacacaactagtaagcaacacagccaagtgtcaaatccatgcagattggcttcagagatcatgcttttactcatgtgctacagtgtgttaaatgctcaccatgtaccaagctctgcactttgcaagtggaactaatttagtcttcacaataagttaataagataagttacagaactagcattttttcccattttacagataaaaacactgagaaagagaactgaatgatttactgcttcaacaagcacatgggctcttggtctatccatcaacgtttctgatagatctgtgtgtctagcccagctcaacattcttacttaatcttaaagaggtataaaaagcaaatatttagtaatataaataagctctcacctcatcaattttcaaaattctggctttcattgcttactacataatttaaaataattactggctttagctcaatgaattgcttctaggaaatgtaacactgaaaaacaacataaatttcccaagtcactagagttatagtgtgttaaacataatgttagatttcaggtggcttagagtcctcaagactaaatgtattataaatagttgcaacagctatatctaagccattaagagcataattgtctcttatatatatagtgaaacattcccagcaattctattaagcaatgagtctgaggttctgtttggaatgacaaaaacttctgtatacccttggtcatttacacgcagttcagaatactgctgccattttacttaacctattttttattgtaagtgaaaaattttactatcttttccaaaagtattgatgaagaattactacaagacctggtcttataatttaaatatatttacaaagagatgagctctactagactagaaagtagttttcaaatttccaagtatcttaaaaagtggactttatgtcccaggctatgtttagtgtcttggtcatgctaatgtgggatgtaaataactggaaattaaagtaaacctatcctcattcccatcatcatcatcatcaccaccaaataccctgtacctgccacatttcaaggactgtacaattgcttcacatctattattatttatcttagcaacctctacataggtactattattcacattttacagaaaacacaaaacaagaaatttcctgtcaacataaaaacagaatttagaaaaggattttcttttgttatacatgacccttcctagtaatccaacaccgttattcaaattcttgcctatacatcacattgtactggaacaaagagagccatattgtgaggaaatgtgagggaaagaaggaccacgatttgctgagactttatagcacttttgatttccagagtgactttatgtataacaaagaaagttaagtattttttacatcacctttttgattttcccatttccagataaggaaaggaggttccaaggttcagcagcttttccaagtcccctactcaagaaacagccaaaattcagtttccaaatgcaatcagttaggactgaaatccagtggacattctgcctcacccttggataagggctctgtgtcttcacctgggatataaaggaagtcctttgccccttgtgatgagacagttacacatacacacacacacactatattttgtgcacccagagtgaagatgaatatctctgtgtttgccatacatgtgtcaagagtctgcttggacagaggacttcatcttggaaaacactgtctaaaggagttgtagttcaaaagcactaaaagactaaatacatttcttactgtattttttaccaagtatcataacaaaaattaattcacagggctatatttataggtctgtcctccctgaagaatagagagatgaataaacatagattcataaataacagcttctttgcattaaatttccatggtttgtctagatcttaaattgaagctttatataagagtgcgtaatataaacaaggttcctatttttgctataaaatccctgttgaagacattgagtttttagggaccatgtatataagggtctatataatagtactagcatttagtaacagcagcaataataaaattctttctatgaacagactaaatttcttatattagataatgatataactaaatattttctggtaaaccactttagtcaatgtgataggagtatttgtcatttcctttttctgcatggctttctttttccattcttaataacatatataattgactcattcacgtctagaaagtttgcagattaaatttagtaaataaaattagataaaattaccttcatttgggagttgaacaagctgagctatagttaaggtttgtcaagctctacttcatctaccccgatgtcttttcagtttctaaagcacagcaaatgttgttctgcctcagagcttccacatattgttccctctgcctgtaaacccccttaattttcttcccactctttgatcagccaccccttgttgatcacatctcttaactcaaacagaaacatagacacatgtcacattttttgcataataatacacttttttaggtcttgatttaatatttgtcttagaattatttttaatgtccaattaaaacaagataccaggccccctcctcatgccctgctattctttataactgtaccttgttcttcattgtatttcccataaattgtgacacatcagttagtttattcacgtgttccttactttaagcctcacaggacaggagacgaattctatttcatccatcattttatctccaacacccagccattcctggtacatgatagtttaataaatatttaataaatggtatgaatgaataaatttaaacacatatgcactcacacacatgtatgtaataactttaagttttctaaggccaagtaagtatatgttaatattttgtgtatcattctattatagtgttttgtacagtaactggcaaaaaataatagcaataataaatgtttaatgagtgttcattaaattgataaaaacattcaaaaatttttaagccacttataaccttttatttaataagctcagataaccacatacttgcaaaacatttagaatttgtataacccccttgaagtctagaacatgagctagctaagtctgagaatcacaaatgcaaaaacacaatttaagaagtgggtaagtgtgcccatattcggaaaaggtgctgtcactcagtagtctttcagacctcctgcaaacattcacatgatttaccatcagtgttgccaacttgtacaatgaagggcagcatataacaggtatacctctattttcataaatattcatttaaatattctaaatatttattgagaggacttaggcttttactcagtgaaatcagaagttactggagagattcgatttaagataaattctttaaaagatcactctggatgctgtgctgaatgtagcctgtactagtttggaatttattcctgtaaggcaggtaaaagatgatagttgatggattcaacaggttctctttgaaggtggttagaagtggtaagattctaggatatattttaaaggcagagctaacaggatttcatgacaaattctcacatataagaaaggacagaaataaatggagatttcgagttttaagcttgatcaattctgagaatgaccgtgttttccattctttttttctactgttctacataagaattaaaatattttgttcattaatagatcatcctaaggcaaaatttatacccttgagcaatttataatcagaacttactattggaatgtaaaacattgtttctatattccttttaattttaattttgcctaattcagcactttacaattgtgagatgaagctatattttaaaatgtcactgagcaattttaagattatataatcacattttccttctcatctgaaaattttactattgttcaacatggagaatgtccttcacattttagcctttagagcataggaagtcaatatttattggtaagtaggtattacatttgtggagtgctttgtcattttttttgacatgctttgacatgtcttatgtcatcccactctcatcatcacactggaagacaggagagaaggaaatttgtgtaggaaattgaaaagtttaagtgactgagtggccaacatgatatctcctcctttcccattcactaatgtattttgatccagctccaactgttggagaaaaactgggagcttggagtgccctatgctcactcaaagctaaatgtctcatacaaaaacccaaatttgaccttatctttattgttaacgcttcagaaaattggataaacaaatcactgtattcatcagacttaatcacatcaccagagtcatctagtcatgtcaccctccattttcttgcgaactcactattttatgtattttctcacctatgccatctttctattttctcatctatgccatctttctttctttcttttttaattaaggaagctcactcacagctttcctggcctctctccaaagtactaaaacttgttttgtgaattgcagtcaaagaaatacaaaaagtaacaatgatcccatcagtagacgtgaaaatgcaagaagaaagatgccattgtaaaacccaacaaggtgtggtagatacatctctttttcttgttgttaaatcctgaagctatcaaacaaaaacttaccttattgacaagggtctagtggaaaatctaatgagcattagtaatgaatgcaccagcatcaatccccttgtctgtagtgcactcatcttttaatctttgacccagctgctgcaagcacctggttcccaaaattcagctagggaaatacaatgggaataataatcatattactgcaatgtctttcttttctttaaattaagctatgcaagtaatttataccaatcgccttttcagaggcagaaatgaagtctgcttttgtacttaaagataacctcagcatagctgacaatcctgggcagttatgggggtggtgaaggaagggaagcaaagtcatttgagaaagtaaagacattcaactgccaacgaagaataaattttaacggatgtaggaagaatcgtttgtaagaagtgcagaaaatgcaaaatggtattattaataagtaacatcattagaggccgttctttctaaccagtcacacctctgaatcatctcgggcttccctgacttcctagctttctgtaccctccagcagtgacgccccttctcccaatcattgtcaggggtttcagtgccatagtcaaaaagaaccttattatctacctgctcccccagcttctctctgagtgacacaccacccacgcctcctccgcacagctttcctcctcccatggctcccagagggaacgtgaggagcaggagagagagaccaaggctacactcgcctgaaccccgaaacgacgaggctttaagacccttattcacccactgagtctatgccctggccgttctgccaacccccgccgcgcgctgcgggagtataagccagccctgcgctgcgcttccagctgcgtctgcccgagcgcggcacgtgctcccggcgctggcgcgagagagcgagcgccaccgccgcgggccccgcagccgttctgcctgctgtcaccgctgcctccatcgccgacactagcgctccagctgcagccaaggccgctacgagagcgcaggaagccctcgaggagcggctgcctgggggcgcaaggctcagggcgcgcacctggtaagcacagcgcctttttctttctcttggctatagttaccacggatataggataccgctggagcccctcccccagtgcagggatggagagcaatcaagcaaggggcgggagctggggctaaaaagacccaggagggcaagtggtgggcaggtggagggctggtagagccaggaacgctacgaggtcctgcaagtttagaaaagtcaccctgcaaggacgtgtgctgtgtgaatcagacataaatttaagtcaggagcctgggctaccgcggtatcgctccaatgggaggtttatgaagatcattttgcttttatttgcataagtgagggatttaagtgggcttgtttccatagaaaacgaactaaaaaaaaaaaacagaggaggaaaagataaagatccgagccaaaggatacgtttggatctctctctctgtgtgtctgtctctctctctctccctctgtgtgtgtgtgtgtgtgtgtgtgtgtgtgtgtgatgccaatacatgtgcacgaaaggcaaggatttaggaagagagatgggctcctctatctttgagcccattaggtgtttgagggagctaatggcagttgctggtgcttcaccccaaaaagaggcagcaaagaagggacccgactgggtgtaaatgtcagtttccgtttctaaaaggactacagtactaggagggagaggttttctggaactgtgggtcatgtaaagatggtacacctgcagctctggacctataaactcaagttcatatactcccagtggagcttggaagacatgtttactcttggttcctttatggaactttggcaaaaataatatctctctctctctctctctctctctctcacacacacacacacacacacacacacacacacacacagagagagagagagagagagagagaatatgaaaaatgaatacagggaagagaagggagctgaatatgcctgaataggctgagtggggtagtagaaggaacaagaacagggtgatcgggtttggcatcactgcgttcattcagttctaccctaggtagttcctggacagatctctagagaaacatgaccttgaacaagccccttaaccttcatgtactcagtttctctattgaacaatgtagaggatcttctgcatttggggacatgaaggtcccatgcagtagtgtctatgtatgtgtttgaagatctgcatactaagaagtaagaacactcataaaatatggataaaggaagcttcaggggattcttcctcaaagtactaaaggcagttggcaagatcctgactgtgctgttgggataatgcatgctgagaggtctgtggaaatgagtgaggaaaatccaacctccagcctgtagctcagtgaacttggagttctgagagctgtttagaaatgttcagatccacagagcctaaagtcatatgctatttttttagtgttttattatttatttatttttattatactttaagttctagggtacaaacctgcacgttgtgaacaagtcatatgctatttttaaggttagcattgaggaagaaggtttggtggcaaggaaaataagtgccaatccagtttaaagattaggtagtcagggcagcaagaagaaggttttagagtaaaacataaatgcaatgtaatctaggcagaggggttaggaagaagaagataatggatattccccctgagacaaggatgtctacactcctaggagacaactgggacctaccatgtccttgacactccttccacctgtctgaggaaggcacaggtgccctttctcactcaatacaggtttattcttagaatttagggatttgtatcccaggtgctgagatatgacggtaaacatgtgaaaagtaagtcctgggagtgcctccagctcccttgccatgtgagcatctgttgacagagctggtctacccatccagattcacccaggagtctatgttcctaaaggaactcactgtgccacttggtggcaccaaaaagttgcgcaaagaactctgttctctataaatacaaactaccacccctccctcctccgctctctccccttccccccatcccccctttctcagtagcggggagattgctgcacacgccgccctcagctcggctgttctgcgcacgctgagcggagggaatgagcttgagatcatcttgggggggaagccggggactggagaggccggctctgccctgctgatccccgtggcccaacttttcggggggctagctagaccgagtctcactgctcgcagcgcagccaacaggggggtaagcttgctaagtgtctgtgtgcccaagtgtcccctggccagagaaggatttaggatctataggcttgctgagtagctcatagtgtggtttgggggagggggacgcgggtggagcaggggtggccaaagccgacaagattcaagtctgttccatttgcgaacagccttaattaaacctgttggggaaaaaggcgcgagcaatggggtgaaggagggaagagctgcaagggttgaaaaggagattctgcatgccttcgcatccgagttcccgctctctaaggccaggtgcgcgtggtttcgaatgcagagtgtgctcccacaaaccacccgagggctcggaattgtgagaagcaaaggtggagaggaaaagaggacagagaattgcttttcaatagatctgttaggggccgcttcgtggcgcctgctgcaggaagaggggggacagcgggtggtgctgaaagcacatctctttcactcaggctatattgcctctctttgaacaccagcctgagccctcccgctctttcctcttccatggatttatctttcccctcgaacacaaagcctgctagttatcccacggcgggggcatgagcggcatgccaaggaggaagcccaggctacagcgacttagggaagaaaacccagggcaggcccgtgagtgcggaggctagccggtggcccgagcccaacgtgcattaggacctctccagggaagtgacaggtccacctggagggctctttcacctggtactcgaatttacagctgccctcatttcctttcagaggagttgctgtgtggaagggaaatttaggagaggataacaagcgcttgtgcttatttagacacaatcttgatgctgccttagctggactgttaacatcgagtaaccaagatagggtctccaatactttactttttcaataagaaattgatacagaccagtgagaaggcagcttctccttttcaccttcttctccattcgctacatgggattttattgttcagagtttctcaggacaaagctagagctaatttgtgtctctaatcctgggcactggccatttgaagcagccaaaggtgcattgaccaggactacgtgcagcccttcctccagtgggacataagcaggggttttctgtggaagtcttagttgcatgacattctactgtcagctgtggagtgttcaggtatgctacctcttgttaggtgtgctttatgctgttttctttatggagtgcagggagtttcctcctttaatttctcagttacctcaatgtaattacacatgtaagaatcaattgtggctatttctgtcctttatgcatgtttatttccatttaaacatgccattggtttaggacttgaaaatactgcgtcctgaactcattgggttagtagtgtgcgtcccgtcaaatttccagccttctccctgtgaaatcttgtcagcactctggacagatctttcaagtttcttaggagaaaaatgtacatagcacttcctaaataacagcttctcttaagagaaaaagctttctctagtcatttacactccacatgacaaaatatacaatctagatattttaattgcacccctagaggtttgtgctatcacacgggaatgttttggctgcgggctacacactcacaaaaagcccaaactcttcaatgttcacttatgaaaggatgtgtcgagatgatttgggagagggagttggtatctgaataatccaagtttttcacttttcttccataggtagacacaggcctttactatcactttatagtataccttatggacatgatgacaaacacccagggggaaattgaaaaattcactcatatctattataaccaaccagcaaaaactatccagactttgggaatacttgattaactacataccatttttaattttggctctgattattaacattgttgtgtttcatgttaaaatgacttacctcatcaaaggtgctcacttttgtgactaaagcattttaataattctacttttcttatttctttccaaaacccatttaatattttataggagtcttactatattgtcttttacagaatgatcattttggttagagaaactaaattaagtgtcaataaaatgtaggtggtactacaagtagaaaatgtgagatgaggttgatcattaaaaatattgtatttatttgtataccaattttatcccaggttttctatcctcatgggatgaagacagagctatatacaaatgttttatcttacacattcttattgtattatgtatacgtacatgtgaggtacttttatgtgtatctcgatatagatagatagatcatgtataaaccaactttataaaatattagatactactttttatatatgttgatatacatatatgttatatgataaagctgatttggctggtttagaggttggatatattgaagatgtattattacaaagcaggaagattctgcactttagaaatatgtgttatgtgttatattcatattcagagaaatattaattctagtcattttagtcagtgagtgaagcttaggagaacataagaagacatgagcatcaaaagaaatatttttagtgcatgatgtatttatataacccaagaaaagaaacttcaatttttagttttgaattttcaattatttgtaaatgagatagtatcttgatattcctttatcttagttgtttaaaatgtgtttctaaaaaacattaaggcataggtttgctttcatttcctttaaattcataggagatgaaaatctatattttacctttctgaatcatcttttaactatatataacttttgtcagaagggccatcaggcaaaagtcttggtgcagactcatccctgctctaataactactatttattaagcacgtcaggcatcatgctaagcagtaggtatgttattttatttaattatcatatcaacaatacaaggcattatttgtttttccttttcagttataaaaactacgttttttattctactgtcaaagaacagtgcatagtttatgcagtgttcactgtgggtcactttatttttatttgtgcaattaattcattatacttattcaataacatgtactgccataacccatcccccattttcaaaataaggaaacatatatttcattcatatatatgtgtgtgtgtgtgtgtgtgtgtatatatatatatataccatttaccatatatgtaaaaggcaaaaataatggaaatatatatacatacatacgcaaaagagagagatttgatttgtttggcactaaaatttaccgtgtttcctttgttttgagctgctttactctgtggtgtggctaaacaataaacattatgggattattttactgtggtttccagtgagttgtagtatgttggaagtacaggctctggcttcaaattgcctgggtttgaatctcagctttgtggcttactacttgtgtgaccttaggcaagttacttaaatttatgtaccttagtttcactattttcaaattgggggatgggttatagcagtacatggcatggagtgaatatgatgaataaattgcacaagttagaaaaaaagcaataggtgcagaaggaaaaccaccatggcacacatagacatatgtaacaaacctgcacattctgcacatgtatcccattttttttagaagacataaagagaaaaataaattaaaaaaataaagtatctgacccatagtgaacagagtgcaaactatcaatcctacccaggcctttggatgtcgagttttctgcgtttcctatgttattacatttaatgttcaactgccctatggattgtgtcttatttttattttatgactttaatgataaaacataatactaacatagattaaataacttgtccaatgtcccacagtacaaacaaaggtgacaaagccggtatttaaatctaggatcatctgatttccaaacttttatgatactgacctacagcttacaaacatatatcaatttttttgaattctactaattttgagtcagcagcccttcctctgcaagggaatgtgcaaatatctacttttctcatatattcaagaatattttaaaataaacatgcaaatgcttgaagataatcagaaatcaaaataatacgtaattgctatctcaaatatctccttttttagtcagactgtagaagaagtgtaaaagaaagacttagatgcaaaatatatattttctgtatatattattctattggtcttgcaaatatatcagattcaagaaaaattctctaatgattagttgttcacaataatgctggttcaggccatgggttttaaaattttgagtataaatgttctgaggaaaatgaaaacttgtaatcacagtgataatagtgagcactttaataatgcaaccttcttacattcattatattttacagaagaataatcaaaaatattttttgaaaaacaatttgtctaaatgcatagtaatgtagaattattcaaagacatagaagtaaataatacactattatatcatttgtttaaaaataaataaaatgaaaaatcaacatgtaaattaatttataaagttatcgttattgttgcagtcttgttaaaattataataaactttgcatttcctatcaagaacagcctttgaattcgggaagtatatcgtaggatactctcctcacattcatttcttgtaatttgtgatacttagaactatgcatatttaatgtaaggtaatatcaaccttgactcttaaagcttaaatttgtctttctcaaattgaaatttctaccttttcaacaagataatacagacaaataactgcataaacattgagtaaggcaagcctatttcaaccgtctctccttagcattatttggaagtttcaggtagagaatttctaagactgatgggtccagatgattggctcttaggtatgctcttctttcatgactatgtcgatcttgccaggattaactttcatgtaaattagtgtttttcaactggaagtgactttgacatacaggcgacatttgctaatatctgaggacgtatttgtttatcagagctgggaggggatggcattgtcgtctagtgaacagaagccaggggtgctgctaaacaaccaacagtgcacagacaacatccgcccacaacaaaagattatccactccaaaatgtcaatagtgctcaggttgagaaacccttatctaaatgatgctaggaaacagagtttcctatatttacttgatttgtttgtatgctttctgatgaatttatgtacgttacataagaatttaatggaaagcagaatctccaaaatgctttgcaatcaatgcatgaggtttgaataaccaattcacttgtttttttttgtggggagacctcattatttgtttattaagtttgggctttggagccaaatatagttggattcatgtcctggttctgccatttattgtaggtttgatactttggagaagattcttgacctctaaacttcgatttctagaggtagtaacataggtagtaattatacctaccttacagggttattgtgagtcttacattaaataattattatacattatttaacagaaagaaggcactttataaatattatgtattaataagtaagtggagatcatgttatagaaatgtaaaaccacggtctcaagcatttaatgatatgtaatgtaatatataaataatgatttacagtcttcagaggtatacccttaataacaagaaatcagctgaaggctacaggatgtgtaaaagtctaaaatccctgctttataattaaactgagactagttaacagtggattgcatcatgtttattgctttgctgcagaaggctgttccaggtcttcatagactgctaaaccacttgtttaaatgatttacaatgatttagtgagctctattgaactgccagaactttttaattaatggataaaattacagatttcatctttgtacaatagtgttttatggccctttttttgttgagggggtttcagttaaaatatggcctatattttgtggggctaaacagtggggatgctgcattttcttgtttacagggtcacaaatgtgtgattgagatagtaatgacaatggagctttcctcagactacagggttctctgtatcattgcacctcaggctgtctcttatctgtggtatgcacttgttttcagaaaaatatatcagatgcattgatggcatatgcaatattgacagccctgactgtttgtgatgaggccactgatcaggcagaagaaatcattttagtgtttatgtcctgagctgtgtgatttgcttgtgtggagattaagttatataagagacatctgtgccagaaagatggtcagtattttagaagattgttgaaaataaaggacaatgtgagctgtgaatctgattatatagtgtagattgcaatttatggcaaagtttatccatcaatatctctttttcatatcatttaggatataatatgagagtgtgtggttacctgatgtgaaatacttttgtatgtatttaaaatatgtctattgttttctataatgtgctagtaattaatttactctgctaaggacccacaaatataacactgagtaaagcatacttctgaaaataggtacttgaactaatatactatataatcaaactattaatacatttacccactttttagtgaattaaatgtcaccatattattagactgtagatcataacattttaaaagcttttttatcattacaagaattaatgcctccccattatctacaggataaacctgcccctttatttctactgacatattatccccaccatctaaaagctataacctaaagaaaataatttattttacttgagaatttgtttcctactataagaaattggtgttcttagacatttctagaagtattatttttaggtagatgtgagatcaagaatgaaaaaaggctctttacgctgaaaataaagtattgtggtatttttcttcatcttttcttttactagacacttgttaaaataatgaatgaatcttgtggtgacgttgcacaggagaaatctcaccacaaggagaaatggccttactcaggaacttatatagaagcaagagagagtagatcctcacagaaagaatattggatagttctcagaattgatgatgttaatgagacagatcttggagtgaagttgatatcatcttttatattctacattcatcagttgtaaaccaggagaaacatttatgccagaaatatcatctttaaataattgtgctacaaagatactttcaaaagcaagcaaaatgcaacattgtttatgatattaagacaaatctataaataaccttaatatctaacaataaggaataattaaatattggtacacacatataattgaatgccatgcaactgataaaattaaataaatgttctaaatgtgactcttggctctggtactacccacttgcttgggaatctgggccaagcctctgtatctctctgagcctcagttcttttctctgtaaaatgtgcatacataacttattttacagtttgtatgacaactaaatgtcatttcatgtgagatacttagcaaagtgaacaacacatgatatgccctctgtatattttaattgttgttataattgtccccatcatccaaatgaacttatatgaaagatatttatattatacaaagaaaataaaaatatattatgagagagatttcatattaaaattttatttaaataaaaaataaaatattataagctttgaaaattatataagagctgataccaagttgtaaactatgattaaaattgtgttttgagtgacattttgttgaattcaagtcccaggtctgctatgaatcatttgctttccatggatctcagttaaatggaatcatctccagggccctctctagttttgtgatgctattttccttaaacatcctacaatattagcttggtaatgaatactataagaaagtataaataaattgccatgtgagcttggaggatagagcaaacactgccaggtgagggatatggtaataatttaggaagggactatttttaaatattagcttattcaatactcactaaaactctttggggtaggtactgctgtcactccaattgccaataaaggcatgaggctcagagaggctaaatgcctaaggacacaccgccaataaatggctgtgccaggattccaattcaggtcattggactccaagcccatgctcttaacaactctgctatgaagacaattggaacaactgcatatcagggatcagaagcagcatgtgcaaagccattggaataaaacagtgtatacttggacaagagcctaacttgactaataggctcccaaggaggaatggatggaaggagataaggtctcaagggagaaagttgcagaaatttagaaagcatatccctcagttccaaattaaaaatactaatgattagcaaatatgttgtattactatatttataaatttagaaaacacagatgaagaaaataaaattaaaagtactatatttttactacccagagaacactctattaatgtcaatgtatatgtttccagtctttatgtatgcatacatgcccacccataatatttcttgagaaaatcaaagcataccgtccctttatttctgcatgatacaacatgaatacttcacattttactgcttctctctcctcacttcacaaaaggaagtttctattcaaaaaatcgttcagtctcctttgctgattattccttaccattgaaccttggaattccctggggcacaacctctggcactagattcttttctctttccacttcctcggtgatttaatccagtttcatggcttacaaaaaggacttctgtatactcacaccttcacattttatctcctgttcagacctctcttcagaattcagccccctacatctgcctgctcattcaatgatctcttcttgagtttctagtatgtgcaacttgatatatcaaaattgaacttatgttgttttgttgtttccatccacatccttgccgccgcattctccaccacagccgatgcgactctatcctttttgtgttcgggctgaaaatcttggcgtcctcattgatttttctctttctccaacatcctacgtcagctctaatagccaatttgttcactctaccttcaaaatatattcagaatcccagcagttctcaccacttgtacttaccgtatctccaatccaacgactatcatctctctcacctaagttagtgcaagtttcctaattttctcttcattttctgccttcgtgcccttattcttgttaaaattttaggtagaatgtgttcctccgctgttggaatcctctcagaaaaacgttctcatgaaatgttaaggccaaagtcttttaaagtccaaacaggttcaacatcaccacattacctcttgttctccatgtcttcctttctctgcattttaacttttctacagccacatgaggctgtttgctactcctcagcacactaaatattaagtctgtcttaggggctttgtatttgctttatcctttacctggaatgttgtttctctagagatctgcatgactcattcctttaattcttttagctatttactcaaatgttattttttcagtttatgcttctttggccacattactcaaaatttcctatatctctggcactttctatactgcttcactgcattttgtttttttttttttgcttttaaacactcagcaccatgtagcacacaatattttacgtatttattttgtttcttgtctcgcaaaccctcttcgaatacaggctccataatgatgtgactttatatctattttgtccataactggatccttggggcatagaagggtgtgctactgaataaacatttatagaaaacacatgagtgatgctgatagatttgatgtattcctttcaggtctatttggaatttatactctatgtatttcttgtattttgattgcacgtaagatgactttctatttaaccttataataatctgagtaatggcacagttctttcgcatttctatgtcatgatttttttaaaagtgtattccaggtatctaagttcatagctaatatctgcctcatcagattaggcttcataatctgatgagctataatttggggtggatattcaggcaatgtaaatacacttgtactagataacctacacactgtaccttctgtgtctctatgagctgaatcatcttttccctggaatgctcgttaatgtatagtttgaaaggcaactcctgtaagattctatatctcttggatgttcaaattgtgtctgggtggcccttcttgttttcatggacattggtagtatctttcatttttttggtaggaaggggctgtgaggcagcaagaaatagttaaaacaatgtgttataaagtcaacaggcatagacataaattctagctccattattttctaagtgatcagctagtttttaacttatcaaaacccattacatcatttgtaaaatgaaggtaataaaataatacagttcaaacatcccaaattcaaaaattaaaaatctgaaatcctccaaaattgcagcatgtttgagtactcatgtgacactcaaaggaaattcttattggaatatttccaatttcacattttaggatttggaacgctcaagcagtaagtaagtgtaatgtaactattccaaaatctgaaagattctgaatctgaattttggtcctaagcattttgtgtaggggttgttcaacctgtacctacattttagagttgttataaggattcttggtatacatatgccacacatacagacacactcaaaaacatagccaatgtgtcagaaatcttcagtgtatagaatgtacatggaatatagtatcttccatgtgaatcggatacgtttttctctgaaatatataagtcttgcatatgtctttaaaaataaagtacctaaaacattcttttttgccctctatgacgtcatttactctcactttatcttactttttgggttgactccttttcatagctggcttttccaaaatctggcccctcagcagagcttattttttagctgtacctttgcaatatttatacttcctctccaggcgatttcatgcattctaaatattttatatattgatgaccctcaatttgcatgtctaaaccaaaactctcccctgagtccaaccttacatattcactttcctgtttgacatctttacatggatatctccaaggcatctcaaattttgcatttgcaaaagaagatcattaattttcttctgcccctcacgtgtttatgtgctagtctaccctatctgtattaatgctgtcaaaatgcactaggctgtcaaactagaagctaggagtagaccctgattcctctctctaccttactactcacatctagtctatcagcaaatacagttgattcaacttggaaaatatatctgactgtgaccacttttctcaatatctactgtcgccaatcatagagaagtcaccatcatttcttgctagattattacaggtttctttataagatttcttcaattgattatccaggaaaatgagcagccagaataatcctttctaagattgaattgttccagtcatttgcttaaatctcctcaatggctttctgttgtaattaacattattattattatcttttcttgagacggagtatcactctttcacccaggctggagtgcagtggcacaatcttggttcactgcatcctcctcctcccaggttcaagcgattctcctgcctcagcctcctgagtagctgggattacaggcgtgcaccaccacatccagctaatttttctctttttggtagagacggggtttcaccatgttggtcaggctggtcttgaaagcctgacctcaagtgaactgcccgcctcggcctcccaaagtgctgggattacaggcgtgagccaccgcgcctggccaacattaaattttttttataagagcctgcaacatcctgcatggcctggacctttcttgcctttccatcttcagcttgtatcatcatgcctcccatgttcttcatgttgtaggcatattttttacgtgactgcctttatttcattcttctgtatatttttctttttcttttttttgagacggagtctctctgccgcccaggctggagtgcagtggcgcaatctccactcactgcaagccctgcctctcgggttcacgccattctcctgcttcagcctcccgagtagctgggactatcttttctttttttaactttaattttaagtatttaaaattaaaaattcaggggcacatgtgcaggtttgttacataaactggtgtcatggggatttgttgtacgtattatttcatcacccatgtatgaagtcaagtattcaccggttatctttcctgatcctctgtctcctcccaccctccagcaggccccagagtatgttgttccccactatgtatacatgtgttctcatcattcacctctgatttacatgtgagaacctgcagtatttggttttctgtccctgtgttaacttgctaaggttaatggcctccagctccatccatgtccatgcagaaaacatgatctcattttttatggctgtatagtattccgtggtgtatatgtaccacattttctttatccagtctatcactgatgggcatttaagttgattttatgtttttgctattgtgagtaatgttgcaatgagcatgtgtctttataatggaatgatttatattcctttgggtatatagccagtaatgggattgcagggttgaatagaatttctgcagtgggagtataaattagttcaatcattgtggaagtcagcgtggtgattcctcaaagacctaaagacagaaataccatttgatctttatttttctttgtattcaccaggtttcagctaaagttaccctttagaatacaaatatgtaaggcccacaagtatagggagcttgtatattttgctcatacttgaatattcaattcccaggacagaattatagcatatacataccataaatatttgttaagtgagttaatgaatagatggggcatgttaggtgctcaatgaaagataataatgatacttaccaatgtatattattacagttctttgttacactagtctctttcactgaatagttaataattttttgttaaataagtaacaaacttcgcataccttcaaaaggcaatatcttagtgttttaacatgtatactgtatctcaatatgtaggggtttcataaaacaacttaaatgaataaaatgcatgggattgatatttcagccacacgagcctgacaggacaccaggtctctcatatcactttgatgttcttacataaaaaatgagtcgtgttttgttatttgttcactcgctaacattctgatttaataagaaattgtgctttctttaactttagatatttctttttgtctgcagcagaattcacatgaccatgagaataattattttaagcttgggtctaaggaaagtgaaagaaaggtttggtaatattcaaatgacttgccaatgaaaaatctaacagtcttcatttcttcctctgtatctacaatgccaacttttgtaccaaaactatttttttctatatattcccaaatgtctagttattctggaacatctggttatttgatgaaatattaaaaagtttagcttttgtcactgtacataggaagactttctctgttgccataggaaacagtagaaggaaatagtgaaaatgatggtaggagtgattagaaacatgattcaagttacattcattttgtgtctggacttaactttttgtagatttgatgacctttgaaaccattagtattcttgtaaaagtgcgatatttacatacattcctgaagaaacatcacctgtatttgaaagttggtgcttagaaagttagtcactttaaaataatttgagatccttggctggcaaagttgataacaaagtaagtctcttacacaattcccctaagtgatcaaatcactaatttgtcaattctcttttacaaattatgctagaatttgccatggaaaatttgggacaaaatttctttcttcccaggaatttaaattgaaatagatgatgacattcatagctatactaaatttctacctggcagaatagttccaaacatacatccttttagcctttgagccttagtgatgtggaatgtttttctggatcagggctagaggactgattactgtgaaatgtattgcaagactgtgtaattactttgaagactctctggaggaccaagtaggttgccagagaattttctgtcttcatgacctagccacaaaatgcccttgaaaatttaataacaacaagatgttgttttgaatatatatagcactttttaacttgtaaagcgtttatttcgttgatatcttgtattgattcccataagggacagcctagcacatagtatccccatttttcaggtgagcaaattctggtaccaagaggttaaacagtttactaatacttcttaatataagaacagggattgaaatgtgaatattcttttctctaaaaattggtgctaatttgactcttccttgcagcctatttgggggatgttgtactctataattccccaaccttttcctttctcttctacagtttatttaacatgaaacacccacctttcttcatttgtttttattatatcttccacattaattagacaatacttatttattcctgagaagattattcaacttgcttgacattgtatttggagagagaatatgtgaggtatttttgaaaagataattttatttttgtaattgcataattaattacatgctcaaggctaaagatttcaaaagaaaagaaagcctaatgaaaatttaacaacagttatccacactttcattaccaagagatcaccaatgtttaatattctggggtgcatacttcttgaagttttctgttcatggcgtagttttgcttctaggatgctctgtcatctctgcctgagattacaatacagttctgcctgccacactcaagatttagttttgtgtattgcaggtgaacaaaaaaagactattaatctaagcaaggcagggtcaagaagctacatcagctgcttcatcaaatcacaaaggaagcagacaaaggaaagtcagaaacgtttttgaattttttttcttcgttatctgcatcatcaaaatattttctctgctaacatggattatagaacttccccaaactagttgcatttatgtttgttaaagacccatgttattttttttttttcaggtttagaagatcatgaccacatggatcatctaactaaatggtacatggggacaaaatggtcctttagaaaatacatctgaattgctggctaatttcttgatttgcgactcaacgtaggacatcgcttgttcgtagctatcagaaccctcctgaattttccccaccatgctatctttattggcttgaactcctttcctaaaatggtccttctgttgatcctgtcagtcttacttttgaaagaagatgtccgtgggagtgcacagtccagtgagaggagggtggtggctcacatgccgggtgacatcattattggagctctcttttctgttcatcaccagcctactgtggacaaagttcatgagaggaagtgtggggcggtccgtgaacagtatggcattcagagagtggaggccatgctgcataccctggaaaggatcaattcagaccccacactcttgcccaacatcacactgggctgtgagataagggactcctgctggcattcggctgtggccctagagcagagcattgagttcataagagattccctcatttcttcagaagaggaagaaggcttggtacgctgtgtggatggctcctcctcttccttccgctccaagaagcccatagtaggggtcattgggcctggctccagttctgtagccattcaggtccagaatttgctccagcttttcaacatacctcagattgcttactcagcaaccagcatggatctgagtgacaagactctgttcaaatatttcatgagggttgtgccttcagatgctcagcaggcaagggccatggtggacatagtgaagaggtacaactggacctatgtatcagccgtgcacacagaaggtaagtttcctttgcatacatcgagtatatattattatgcactcaacagttacaatttcaggtttgggaagagtaaactattcctaattattttggatattttgaattgtccgagttataccagtactataagaacagactggatggcatatatctagagagacaaagacttaaactacagaagggtgtatgtggccaatatttggtgaaatataattttgttttcattgtgaattacattatttacttctgctatactgatgctatattatacttctactctaatgattttttatattcattactagaggttttcaagtctctatatcttcattgaacacctcatatttttgtcatttcgcgattgttctaggtgcctattgtttctaatagttaaagcaaggtacacataaatacacataggattgaaggtagtagccagttctaacctaggtgtgttgttatagagaattaccaaaaagtttggtcttacagctattttttcagaagaattcatggtcaaatccaaaatggagataagaataaattaattttatccttgtatagaacatatttgagaagtataattttaaataattcaacatgtttgttttaaaatttattgcttctttgtgctccaagaatagtgaggaaagaaaaatctgactgatgttttataatagttaataataagtagccctttgttttttatggtgttttaaaaatcattagttcttgaccatggctgtttggaaaaaatttgttttgacctacagaggttgtgacccaaatgggcagactcgcttgttatgcagctcttcttctagaaaaaaaaaaatgtgtatattaaacactatagaatactgaagaagatacaaaatactttttataaatcatcgaattattgtatttgttgagattcttaaaattctgcattaacatatcaatatagtccaaatatttcggtctggtaaaatgtggaattaagttactaaccccacttcagaggttaggaatatatttatgcaacacatattatgcacaaatacatatgcaaggctctctgaccgtcctgtgaatgatagccctttgttttctatatcacagacttcagtgggattgcaatctggcaaaggagatgaggcatgcacaaatacttacataatcataattcaaaatgacacaatgttacaaatctgactctaaaggaaattgatggagaaaaaaatcacctcctcctctgtggttatgggggtcatggtgggaatcttacagaaggaaatggaatttgacaattgaaatttaacaagaagaatactgacaattggtgaaaattagcagggatggctttcagtgaaaagcataagaaaatatgactaggtgagaaagtaaaaatgtgcttgaaaaggccaattgtaaaggtatgttttggtttgcatcaaataaatcatgcattttattagggactcccttctagcttcagaagatcagtgcttggtcacggtgtggcaagtgctaattcaattgtgccccaagtgaaactcttagtcatgacctttggcttttactagtttaaactgttgttttatcctaaatttaccccaataacaatctaataacctaataaaataagttatgatgtattcaaacaatgcattatcatttagctattaaaataagtgagacattctactaggtaatgattataatttccaagatcatcttaggtgaataaaacaaggggcatttctgtatatataacattttattttttctaaaaggggtttttatgcaaacaatttgattggatcttcatagaattgttctcagagaagagcaaaactactaagagttgctgcttctgagaagaaatctaagttaagaaatgaggtggaatattttatgcataatttttatatacatacactttaagctctatattaaatacataatttacctactgaaatataacaattacatgaaaacattctatttgtgggaaaacaaaagacaatagaaattgcaatgccaaattcaggcaaaatatttaggttgtaccaccaggattcaggagagaacaaaccttggaattggacattcaaaggttggaagaaatactcgtttgcttactgtttatgtggttgtgtcaagaaatatttatcttgctttgatcccaagcaagtatgtgaataacgaggttatgtagtgttaagtcttatgatttatcagtacaagaatggcatggtaggaattttcacaaggtgaaactcacctccaggatcagaaaagtgagagtcaaacaggatacagctttgttgggtactgtgggaactctctaaggtcatgcttttttttttttttcctccccacttggtttttcagaaagtcttggtgggatcttccatgaaatgatagtgtcagttatcatccagtctcttcctctcactgggttgaggtgattttctctagcattaggagaattaatcccagtacttgataatttatcttcatattcttataattattctcctttgttccatcaatattctctttcttgaagagtatggaaatttccaaatgctttcacatgaaccattaaggtctgtgaaaagatgtggtcctattttcaaaaaacattttttctcctaattgcctatgtgttttatacttaaacctaaccgtactgtgtcacgggtaccacaagatgttccttcaagaaagtgtatgtcatcacagaattccagaggagtgtacaaggaaaactgggtttcagcttcgatgttaatctcttacacttgctatttcctgtgatttatggctttagtaggctgtgtgactgggtatttactgtggcttgttctattacacagaaattatgcctggaacttctaggcaaagagatttatagtataaaacagaagaagaagaaaaaagaaagcattttttaaagagcagatcaaactagctcttcaactgggcagaggaaaggaatatgcaatgactcagaagaaaagtaaaatcacttcttttaatggagtaagaactctctctgcactaaggaaatgtaaagggtcctttgccttagtacttttgcaaaccttgatacatgtgcccacgatgacacaggattgatggtgcttgcccatttagcagtgtggcagattgcattgatgacgtctactaatggtgcttctgtattcacatcatttgcttttgacttgataattcccttttactttcatgtagcactggccttctgacactttgaccaatagcacttggttgacgtgagaactttcttcctagtttgtgttggaaccctattgtcaccctgtgaagtatgagagcacccaggttttccaaatgagtgcatcttagaccagttgacctcaaacatgtgagagcgtgcaatgcagatcaacaaaattgcctttccaacccacagctaattgcaatcacataattgagcccagctgaaaccctcaacattacccagctgactattattgttagcaataaaaaatgccttcaggatggagtccagtataaacatactcatccctctcactttagtctctaacttcccttctcccaaatcagatactattgcttaaacttcaaaagcaaaaaaaaaaaaataacatgcattaatattcttgaaattcgaatatgaaataaaacagaatatatgctgtgggcaagaaagaatatttaaaatgctttgcctatacttctgtggctagagatgtgatagttcccttaaagtctgaatgtttcaaatagttaagcgcttgaatatatttcattattatattctttaccttgatctagttcaacttcattaagaaaagtaattattgtattgtgttttatacaaaaaaaaattttatattgtacttcctgggtgattgacaagatttcacacttcactagttttcctgactttagttgaaaatctacagcatatccacagggcctattagagtgcccatcatataatatgtgctcaaagactatttgctgaatagaggaatttgtgttagtgaagtacgtagctcaccatttatgactatatagtatgtggataaatagcaggcacttgtaagtttttagttttgcttctttataaaaatgaggtgtcaaaatgactcccttgattaattgtaaaatcctgttcacgctacacttcattttctgttttcactggttcttgaatttattatttctgtctaatgacaggaatgttaatttgttacagcaaaaaacaaatcagtgatgttctggggagaaaaatgtaccaataaattgtactggtagcatacattattgaagatatggtcttcaggttaacctagagattgcaatttcaggttataatatgacttcccatcagttatttacttaaaaatgtgataacaatccagctttgattgaaggaacttcagtatgattcatagtctatatgcttgtttgacttctaaaaactgggagtacacttttcccatctcagcatttctactaattatcattacacaagacaatttaccttggaaaaataataaatggtactgtggaagctactgaataatttttaaaaggactttattttgtttctccaggaattgaacagtgctgagagttaaaacaaattttgggatgatcatggtaataataaagacacataaattactattcattccatagaatgttaacactgtgtctcaggccagcatttaatcttctgtattttacggttaaggaaactaaaatagaaaggtcacataactctaccttgcttgtcagataattagttgcagagttgtgtcttggaactcaagatttctgtccagaacttggtttccaaaacattgctggagattattagtcaggttcctttttgccatttttctacctctccattgcattgttttattcactctccctttatctcagtggcaccaatatttctaaacaattggctgaaagtgttaataactatctgaaatagtagaagggaccacaaatgaaataattcatctaaaaattagccttcacaggagaattgcttgaacctgggaggtggaggttgcagtgagccaagatcatgccattgcactccagcctgggtgacaaaagcaaaactgtctcaaaaaataaaaataaaaattagccttgagaaatagcatgatcaatttgctcttgatctgtaaattagatgaagtgctccttttcctgggtcgtatcgaaggtttgcggaaactctgaaagattttcctttgctccacaaaaattctgaaaacatgagatccccagaaatctttgaaattatggattgattgtataattatattggttaccactgacttaacaatatatacaatttagaagatgcagaaacttttaggggaattctttagtaagttggatctggatccgtaatctgggaaacacagtgggcaactctaattgtaaagaaacagtttttcatattcatatatcactgtcagaaacttcattgctagcagtgaaaaaaatacagatagctctggaaagagcgtttagaggggcattccctcctcttcccttccagaaggaacagtctatggactcagtaaataatttctaagagagttattattgcctctttcagagaaaaatatagagcttgctgacatatccacatgtggtttgggcagtgtttcttctatattcagattcatttctaatgatacaatttctggcttagactctggctcacctataagagactaatgcctgggatagcttcccaccttcctctctcttaggcaccattgctgtcatcaattgctgaaaatactagaaaactcccacaaatactccatgtccaggatgactaagctgagttaaaaggaattttgttttcagcggatttcactgcactgctcccccataatgcagaaatatctctggtgatgtgcaattgtggacacttccacagttctaaataatcagatgcttacctaaatgtgaagatcatctcttaggatgtagcctatcaggtattcagtatttacccatcttatggatggcagctgcacacatgcatgttttcccttggtcactcttattccagatgtcattaaaaccttttagcttctaggtttatagtgttcagccacttctgttgaagttgcttctgcataaggaatgctggggaatgagagggcatgctgtgagatgtttatgttccagtgtacagcttgaaacacataaaacacagaatgaaaagcaaattatgcacagtaaattctgcccaacataaactaagcaagcatgtaagagaaagcaagaatagagatcctcaaaactctagagggagtatcttgagaattttttttcttccttccctcctccttttcttccatcctccttctctttccttcctaccttcctttataacttcttaccttcctatcctccttcccttttctttgtctctctccctttctctctctcttttttattctttgagacagggtctctctctattgcccaggctgaagaagagtggcatggtcatagatcactgcagtctcaacctcttggtctcaaacgatcctcctggttcagcctcccaagtatctgggactacaagcacatgtgaccacgtgtgaataatttttattttttaattttttgtagagatgaggccttattgtgtttctcaggctggtctcaaactcccacctgccttggcctcctgaagtgctggaattacaggtgtgagctacgacaaccgacattgtctttctttcttatttatcatttttcctcatctctttttatctggaagcgtttttgttttgttttgtttttgtttttgcaggctcttctgtaagtctggtcattatcctgttaatttgatagtgaatagataaaatatgatgattacattaatgctatcttggagttggaaaaataagttaaaattactaactgtgctaaaagtaagataactgacatgagaactaaggattttactctgtgactccaagaaagtcacttcaactccttgcatcttttttttttatacaaacaggcactacaaagaatgttcgtacagatttctttcaagactaagtttctgtgacttgctatgctcaaacttctgcagactacagctgggctacattaaatgttggacatagggtgggcaacataataaggctctatctctacaaaaagtaaaaaaaaagaaagaaaaagaaaaattagctagacatggtggtgtgcacccagctccttgggagactgtggcagaggatcacttgaggacaagaggttgaggctgaagtgagcgaagtttgcaccactgcactcagcctgggtgacagggcaagaccaatatcaaatgcaaccaagcagggcctgttcaaaggagagtagcccaaatggttatgcaatttgaaatcatatcctcagaataaatttagtagagagaagacaagacacagcagggccctgactgctacctttaggtatctgatatatttacatattttgtttatttagatatttgtaaattcaggtggaaaagagctaggttcactctggccagcagttgacagagacagctaattactaaaatacaagagtaacaaagtatggtttaatttaaaaaattttttttttgtttattagcagaactgttcaataaaggaattgccactcttaggagatagtgagttagttctctgtaactccttgtgcacaaacctgcaatggacaatcacttggaggactctggaaaatggacttaaacctcagttgaggaaagaacgatgttggactatttgttcttctgataattcccaatgttgacaatcagttgccattgggatcttactactttgtgagttgaaacataatcactttatatatatatatattttttttttttattttgaaacggagtctcagtttgtcgcccaggctggagtgcagtggcgcgatctcggctcactgcaacctccgcctcccaggttcaagcaactctcctgcctgagtctcccgagtagctgggattacaggtgcgtgccaccgtgcccagctaattttttgtatttttagtagagagggggtttcaccatgttagtcagggtgttcttgatctcctgacctcatgatctgcctgccttggacttccaaagtgctgggatcacagacgtgagccaccgcgcctgaccatatatactatattttaaatttggttagtttgtttatttcataacacagtctgataaggtaaccattttagtagaatggacaagtaaagagtgatttttttctgcagctaaagttagtggcagagcaaggatttagatccaaagccaactcctttgaaacaaatctaaatctcattcctttacattggagtaggtgtggctccaaggaaaagtaggatggacatcacctggttctttttccttccctgggaaacaaaaaaccctacttgtttctccactgagagtatcttttgagcatatttttgtgtctttttatctagctttgaaagcagcacctttccttgttcccatggaatgggttaattatagtgaaaagaaaacaaattaaggaggaggcctgtggtaacaagttgacctcacagaagacctctttgtgagtctgatgaaaagcacagactgtgcttggttatttctatttacatctccatcacaggctccacactctgtccttcagatgccaataatagcaggaagcaatatggtacagaattttttaagagctggaggatatattgttaaataatgtagccttatatatgaaaggcaattctttggaattcatcagggttgtgggttatgaaatctcattttggcacatttgcaaatactccagaaagatttatcaaacattcaaatgttgaattgaggagatgttttggcaagaggtgtaatagtcaaatacatttattttaggggactttgtaatgtgatttcagcccaatgttacatttacacattgattttcacacacacacacacacacacacacacatgagattctaaagaaagagattatctagtcggtgtttttcttttttttcaaatagtggataactcataagttatttgtaaaaccaatttagagggttgaaatcagaatttaatagagaatacattaaaatagactagagtaaaatataaatatcaacatgtattacatcataggttaggtattttgtaaatttcaccttagttacacatagccataaatagcctgtgggttaccatttaaaatatatttcttctgtgtcttgaagctaaaaaattaaaagtttaaaagtgacttactctacttctctttttcatgttattcctaaatacttttctagagaaatgtaaccgatacacatgaatttattattctgtgacaatgtcatttaatttatattttctggagtgatgggttttaggtctcatttaaaacgagcaaaaatttcaaggcacccatggtaggaaatgatagaagcattgaacaactgtcttttagggcaggtatttttatctcaatttgataataaggaaattaaatttacttgtccaaagtccctcaactagcaagactattaatcagtatttgtactcaaatttgcctgggttcatcctactacttaaatgagaattatttcaaagggtgaaaaatcagattccaaggatatatttgcaacaaactgtgaatttaagttattgcactgtaggttactcattgaacaattataccaattatgtaaataattggtataattttggtaaatggtatacgcatcaggataggacaatggagtggatactagacaaggaggtcaggcgagtttctagtcctagtttttatcaatgataaagacaggctgggagcattttaatttttaatatcccaatgtagtacactaagaaataaatgccaaaaatattattattttgacattaaacatttacatttaacaaattaacatttctaactcccccccacacatacacagagacatacaggtacaagcacataaaatataaggcatttgtgccatttacaagataactttttggctatataaacaagtcatagtgcaccacatgtgcactacgtgtaataagccacaagtttaaatatataaagtggcagtcttccactattctctgagtgtcccaaaaattatatgaataatttcatttgatatatactcaagtctaaaatttagacttcttttgagaatgagaagcttggaccaaatactatgggtaaaatatagtatgataatatatgagagtgtgcttttaaaagtattataaaagtagtttaatgaaataagtaacctacagtgcaataacttaaattcacagtttgttgcaaaaatatctttggaatctgttttttgacgctttgaaataattctcatttaagtagtaggatgaacccaggcaaatttgagtacaaatactgattaatagtcttgctagttgagggactttggggcaaatttgagtacaaatactgattaatagtcttgccagttgagggactttggacaagtacatttaatttcctcattatcaaattgagataaaaatacctgccctataagattgttttgaaaactaaatataaagcacttagtatcaagcttggcacacagaaaacattcagtaagtatcttctaaattttcctgccaagaacctgtcttgccttatcttggccttgaagaaaaaaaccataaatgatgtttcaattcatcattgcccagttataattgacaacataatggagtggagaattggtcaggaaagttaccaatatatgtagtgaattttagactcttactaattttcactttagaagataagtttgcaattgcacgaaaaaggtagggtgcttattgctttggcataagtacaaatacaccccacgctttcctcctccaattggtgatatatgttgagaggcattatgctgtggtaagatgagcaaggcctggacagttccagagctgtgaacatggttatctttgatgtgagtgggtgtaggagatgaaactagaggggattaaagatggaaacttaacgctatacttcaagtacttttgaattcttttttacattttcaacaagcataagcaaattttatagtgaaaaaaataggtacaagcagtagatagataacttctttgtaaatttcaaattggacatgcttatgtgcctttacttctccaactagaaacttcgttattagaaacaagttgtagtacattgagatatgccatgggcctgagtttaaaaccaaaaaaaataacatggaccctaggaaataggcagattacatttaattgctgcattagtttgaaaactaaattaaatgctctgccagattgttgtagttccaattataacaatgaatatataacttatttatgaagtgtttattttcagaaattgtcaaagttcctttattctataaagtgatatcaaggtggattttcgtgctgttattaatatattattaatactacctgaaagtcagtagtctcattcatagctgcaatgaaaagtagatagaataaaaatagaatgaaaagatatttctgcattcctttcctcaagaacaataaaaatataattatttgtatttttaatgatttcttcagaaactgtcttcatattgcttggttatataccctcttttcaactgtcatatatttgaccttcactagatttgggttaggatttcaatccttgactttccctaataaagttagagtgccatttttgttaatgaaaaatatattactgaattacatatgatagcattttatcctttgagaagctgaaaaaatataaaagttaagtaagacatactgaagtacatgtcagtttaatttcacttttatggaattagtgcacatgtactctagaacttaaagtataataaaagctacaaatgatgttgacaatatgtttttatggaaatgatttcataaaacaggaaatacatgaagacagaaatattatactctctggttatattatttgtaataaaattgaattttactgttttcaattctcaatacattcattcatttcttataatttggatgagaataactgatattaattttttgctcagaggatacaaaaacatgtaaataactatagattccattatatattatgttaaaactataggttttattaaaatacatatgctaaaaatcaagcttgcaatattatacgactttgtatttatataaaattgataacagcaaagcctcttatacctaatacattccctcccaaaaaaaaaaaaaaaaggatttgagggcttggtagtactttaatttgacaagattttgaacttataaaaataacctaaaacttgtgttttgagagaaatttttggacaaaatataattttcaatgaaatacagatatttgcatttcaatgcaaatatatagtccatgaaagcacaccaaatagagcttgaggtccatgtgatactaccacaaataaattattttattcattagtctacaaatatttattgggtagatactctgtactcagctctgtggtagatactgtgaaaaaagtgaactggaagcacttgctagcacatgagttttctcagatatatacaaagccatggctgcataaaaatagaacatttcccctcatagaaagaatatgttcatatgtaagcagaaactcacaaagttatctatatggcaagagatgaatagaatatgtatggatagctttggttgaagtaaaaaaaattgtgtcgtgtttttgtttaatataatgttattttatatcatttagagcaccgtagatggtgtagtaagtaattcctttttgtttatgctattgaatggctctgattcagtatgaagatcatcagtactgttccctttgagatacgaagtctgagttgcacaccattaatatctttttttataaaagagtgagattttaaatcttccacactgacagatatagcatacaactttaaacaataacctataaaatccataataagtaattaagatattctctggcttatttaacagtgaaacaatttatttttaggactattcgaccctcataataattatctaattatctgtgtggaactctggaaagacttaaataaacactttttatattttaaccatgctacatttttcttggtataaatttaacatctttgactgaattgattcataatctcaaatatttcttgatatctgtctcttttttgaaattctcaatcttatttttattcctgtttttttctgagtcttagctttttactttttctcttcttttgaataatcaatataattgatgtttggattgaattgctttcacgtatttggaatgtacctttttttaaaggagactgcattatttgtgactttagagattagtaatttgagtatgtttggctggaaatttttctcctagcttcaaaacctgttacatacttttgcttttaccttcaatctatcaatacatggaaaattaatgcatacaatttaaaaatttgaagaggctgaagagagtataacacttgagccattagctggataaaaaaatgtcctttagaaacacaaaaaagaaaaatttaaaaattcaacattttatatgtgaaatactaaagtggacatgagtggagttttgtagattgtacacaatttctaatcataggcaaatgaaataaattttaaccattcctaagaaagagcagaaattaatgctgaagtaattcagcttgaatatgtaaaactttgtttctgatacttttataaaataaaaacaatttggtttcaaggtcagtggaaagagtattaatcttggaattgctctggaaaccatattttattttccactttgggatgaccttgggcagctcacttaacctttataaatacacagatcctcatttgcaagatgacagatggctgtacctgcactttctgtactaatgttttgttatgatggtcaattgaataatcagttaatgcactttgtaagtgtaagactgcctgataaattaattattaaatgaacactcactatgtgccaagatctatgcacttggactaggcttttaagttttcttacaaaatattgagtacagtactttggaaattaggtgctaatcaaagacttcattaatggtgtctttataacagcaaaaatagtgagatattgattggctgggggaagaagttaaactcctttttcacatatttatgctccatcagtaattaacaatattcattaagtttcagatctggaagggacagatctgagatttctaacagtgggagctctgagtagtcatcaagaaagagtgcagacattgaattcagatacacttgagtttaaataccaggtgttatcttatttgctggtccatcactatttgctgtggaaatgaggcaagttccctatgcctaaattaccacatttcaaaaaagggatgattatcaatattgttggctcataggacagttgtgatcattaatttagcgtaatacttggcacacaataagggttcaaaaatgttagttcctgctagtatttgttcttttttaacctcctcatttttagaaaagaaactcaggtctaggaaatttaaacaacttgtctaaggtcacagagctggtgagtaggagtgcttgcacagaacgaggctcctggtgccagggtactgttgggaaaatatgcttaatattcagataatatttattttaaggcactcattctcacaacaaatgtatgttctattataattgaaatatgtatgtatatatattatatgctttttttagtttactgtttttatcactgtgtttaaggacatagatctagactctatggttaaataaactagaatttgaacaacttatttaacctttgtaaatctcaacttcatcaattgtaaaatgattgatgctgctactgctagaaaacaattacatgaaatttatcaggtgtccaggcagttttctgagcacattgcattcattaatttatttaaaccaagtcacagaaaatgaaaataatggtaaacaaacataaaatatttatgcaaattaaattaatagtatttttaaaaatatgtatgcaatatttatgatgtgtagtatataataggcagtcaataaatgctatctgttaatactatttttcttatttttgttttggcctagccatggtttcaactgtaacttctcgagtcctttctttgcattttgaattattctcctaatattctggtgtctgagaacaacttaaactatatgtattaagtgaaaataaggaggatgcaaataatatattttaaaagatacatgatttccaaatataaaagtgatttaatagctaggtattatttaacatttagaaaagaaataagagaagaaaaattttttaatcactaatattgcaacagaaataaaaccttttaacattttatcatcatttctaattatcttatgcacaatttaaaaaagcagctatatacataatattggatgtttttgtttgcattttttcattttactgagcattgtaaggagcacattttctcttgttattcatactttttatggacattgttattcgtggcattataatatcctgtcttttctccacaacattgccagtttgggagccctcagagtcttttttatttttcacaattccaaaaagcacataaaggaacataaatatgtgatatttatctctgtatttaaaaaatctaattaacttaataacaacaaaaacaaaaataatcaaaaagattaaattcttgtacaacttgaaaatatattaatagtttttaagatttattacttataatagcaatattgtaagtgttttaaataaataattgctggcataaaaagtttagttagtataaaaacactcatcttactactggcttaagaaagaaaacattgtgcctatcccttcccatggatatcccactttaagttgttcttgaaataaagtttttgtcctacaaaatataattttgaagttttaaatatataatgtgtccatatatccagagtaagatttttactaaacttttgttagacctcaactctaaggtaaatcatcctttaatctttcttcataagttctactcttaactctacaagtaatttttatttcaactcttccaataattctttaaatcatctaattggataaattttcccctcctagacacatttatatttagaatcatgtttagttttacttccaccatggactagttagtcaaatacgcatgtaaactatagggtgtttgtccatagtattagaatattttaccaataattcagtgttcttaagtataatagggcataagatcatagaattttgaatcagatcatctgttcctaagattctcaattttatactaacttgagaacatcaaacaacccatcttaaggactttgtttttatatatttttaaagagttattctttaaatatatgattacttttattgtcatagctaatactaactgcttaatatgttccagccattgtggttctattttatttagtccttacaataatgctatgagttaagtacttttaattaccatttaccagatgaggaaatgaaggcacaaagacattaaataaaagaacgtatttatcaaagtgctcccggagaaagtcaacctcacatggccttatgattgtttctgtcttgctttttctccttttgctggagaaaatacttccccaggatggatggtgttgatattttgagattaccacaaagctctgtaaccactgataaagccaaagagacacaatatattgtataagaaaaaaagcatttgggctctcttataaaggccaatcattctgaagacacttttattgaaaaagaattttactggaagaattagggaagaagtcaaatatccaagttttatcatttaggaagtacattagggtcagctgatcaaaaaaatacgtttcataattgcacccgttgtcattgtattattttgaaaaaagatgaattctggttaatagattttatactaatgtcatgctttgtgtgttgttattggtgtcaattttagagttcttaaagagagacaatgtctcccagaaagaaggaaaaagcaagaataacaaagtataacaatataacagtagtaaaaaataaaatgttgtgtaatatgacatctacagctttggttgtctcttttgttgcttcccgtggcactgtttccctggaaacccagcattccttagtgtctactacccagctaaccaccttaccgtgattattcagcaaggaagttttgtaaacaatttagtaggaaatcttgaataagagatgtaaggactttttaatataaggcatttaggaaataaaaagtttcagtaggcctcatccttttcatgcacaaccacaatgactcctgtaaaatctcattagggatgcatctggaataatcaagtatacagcattctggtgttaagaaaacttgaagaaagcctcaataaactcaatgcttaaattttaacatgtgtaatgttaatgttcagagtgctggtgatagaaaactagaaaagcattctatagatttattgaaatatatgctatacgtatgtatatgtcctgctatcaaattataccagaatctgaagaacaaagcactagtattaaggagacttaagttttctatcaaccttctcactaagtatggttgagttaatttatctgactttgttatgtcactaattatcacagcttatttcctattatattgaatgattccttcaaatattatactgacagaataatccaaaaaattttttaacagtgtttctaccagataacttgtagttttccttttctcattaacatgttaagcttatttgtgttacaaattctgtaatgttttggttagaaaaatgcccatcaatgatagactggataaggaaaatgtggcacatataaaccatggaatactatgcaggcataaaaaagatgagttcacgtcctttgcagggacatggatgatgctggaaaccatcattctcagcaaactaacacaagaacagaaaaccaagcaatgcatgttctcactcataagtgggagttgatcaatgagaacacatggacatgggaaggagaacagggagggtacgtaggggggtgggggactggggaagggatagcattaggaaaaatacctaatgtagatgacggattgacgggtgcagcaaaccaccatggcacgtgtgtgtatacctatgtaacaaaccttcatgttctgcacatgtactccagaacttaaagtataattaaaaaacagaaaaggttaatttaattttctattactaacaaaatgaaatcaaccaattcttttagagatgtactgaggcatctttcctttttaagatcattacattgtgtgtttattaagggttaccaaacactttcgtcatgtgatatatggctaaaaattatagtacttcaaatgtgttttggatttgtttttgtctttctgacaaggtcttattctgtcactcaggctgagtacagttgcatgatcatggctcacagcagcctcgacctctcaggctcaagtgatcttcctgtctcagcctctttctcagtccctgatctagaactacaggtgcacaccaccactcctggctaattttttattttcattttttgtagacacatagtctcactatattgcaaaggctggcctcaaactcctggacacaagtgatcctcctaccttggcctcccaaagtgttggcattacaggcaggagccaccatgtctgccaaaatttgatacttaaattgttaaaaaaacaggtaataaaaattgggataagtgctgcgtggatgttagttataattaatgaggatgtgggcttcttgtagtaagggtttgtcttagtttgttttgtgctgccataccagactaccacagactggattatttataaacggaaatgtattggctcacaattctgttggctggaaggtccagtatcaagacgctggcagatttgatgattctaagatagtgccttgaatgctgtgttgtcctcctggaggaagaaatacttcatctcacatggcagaagatccaaggaaaagagggcaaatgggggcctaattcatttttttaaaatggcattaattctacaaatgatgggagagccctgatggccccatcacctcccaaagtcccacctgttaacaccaccacaagggcaaatttcaacatgtgttttggagaggatattcagaccatagcagtgatattaaatttctttgacattgttcatagcagttgccatagttttgagtacatggaggtcaaataaatacatactgaattatatttattcaatgttgaatttaaatacgttcatatgtcctaatgaaaacagaaatgctaaataatatggaagtgtttcctttcaggatttagatgtcatggtcttattttgtagactagaccagggtgactaatttatgagagcttggtcagtactgcaaccccagggttaggattttttacttaatgtagaagtgtgaaaatcagaagctttgtcataaactattttcatctaataaaccaaacttcctagtcttccttgtttcagtagcctgtttggcactgtaacttagtaactaattccttcaggctttgaaaaatatttgagtgagtaagaaaatgccggccaggtgcagtggctcacgtctataatcccagcactttgggagtctgaggagtgtggatcacgaggtcaagagattgagaccaccctgtgcaacatggtgaaaccctgtcgctaccaaaaatacaaaaatttgttggatgtggtggcatgcacctgtagtcccagttacttgggaggctgaggccagagaatcgtttgaacccaggaggcggaggttgcagtgagccgagattgcgccactgcactccagcctggcaacagagggagagtccatctcaaaaaaaaaaagaaaagaaaaaagaaagaaaatgtggtacagctttgtgggggtggccagtgagcaagcatccaatataaaagagaaggcaaacacctggaaaggaaaacttgtctctgtctcttgagaagatgggatgaagccctttttcttctgtcccatgtgcaatcatttgaccattccttacttcaacacctccacttcgtcacatgggttacttaaaacatatgacttcaataggttgtgaaatactgtgagaagacagaaataactagtcataagattaattttccagggtgactttccctgttgccctatggagttctcttttcttaaaagtattccatttaaaggtaaagaaagagtgattaatgtattccttttccttccttccagcagggcttagaatatgagaaataatagtagattgcatatactgaatgactctcatgtgttagtattttcatatatagaatctcattttattttcacattgtcttacaatgcagatataattgtcttttataggaaccaaggaaactaaggtacagagaaaataagtaatattacaaagtcacagtaaacttgagacaaaattttattttagatgtttctcactccaaagactctttctattacaccatgctatctatattcagtgttccaaatgcagatgctaaagaagtataaagtgtctatatgaaaccctgaccctcaattctactcatggagtcaactactattggcagtttcacattaaattttctaatttttctctaaattttttccccttaagttttactttaggttcagggggtacatgtgcaggtttgttacatgggtaaattgtgtgttgtgggtgcttggtgtacagattattttgtcacctgtgtaatgtgcatagtacccagtgagtagatttttattctctccctcctcctaccctccaccctcaagtagtccccagggtctattgttcccttctttgtgtccatttgctttcaatatttagctcatccttacaagtgagaacatgtggtatttttctattcttgagttaatttgcttagaaaatgtgtgttgccaaaaagagcatgattttgctttttttatggctgtgtagtatttcactgcgtatatgtaccgcattttttaaatctactccacagttgatgagcatctaagttgattctatgtctttgctattgtgaatagtgctgtgaggaacatatgcatgaatgtatctttatgttaaaacaatttatattcctttggttgtataaccagtaacaggattgctgggttgaatggtagtactgttttaagtactttgagaaatcaccaaactgttttgcatagcagctaaacaaatttatatccctaccagcaatgtattcttttttctatgcaaccttgccagcataaattttcaccatccatttcttttcctccttccctctctatctttatattttattaaatcatatttgaacaaaaattgagattgatttttgcaccttcctttgtgacttaatttaaaaaacaataatgatatatcatgaacatgttttcaattccatctgatgcattttgtaagcatagatcacttccaggttattgcgtagttcctattattgcatgctcctttataattaaagagtgtagagtatattgactctactctccttatgtctgcattaacctttctcatattttcactctcactgaagtcttcatcaatatgacctatctttacctttccatgttgtctcttgttgccatccttagcaacttccaaacatgtttgctgtccatctgagccactgagcttacaatttattgtcagccaccagggcagatccagtctagtgatatctcttgaacagagttaaggttgcttcctggtagttagagacacaaatggaggttttctcttcggactagaaaaggatggttcataacatttttttccttatgccagtactcccacatcctcacattacaagatacagaagaaaaaatgaagccagtataacgtgaagatgactttctagatttcattcttaccacacctaattttcagcttctcctgctaactaacattgtatagatttgtggcttgaggcagacattaagaagatataaataaatcttttttagtggaaaaattgtctgttagtggtgtagagctcatttgattacctgtcctttgagatattcacttgtttaacagtcagttatggttatttagagagtctactatgaagcaattctgggccaaggtgtagataatttgttagcagactgtgaaggtccaatattatatttcaaagcttgattcatacttcaagcttattggccaaggtattagatttgttttttccagtaatacacataagaattgaaaatatgtcattgaaagttggacaaagtagaaaatatttgttttcccgatatttttggtcataatatattataatagaatacaaatattttctgttattttgatcttgagatctttgagctaaagaggtgataagatatacataaacatccctgccagtattttatgtttaataaactctacctcaattgaaaacttacattatttgaagcaaattaaaaatgaatttaatgccaaaataaacttcttcattaatttggtagatgatcagaattatttttgctatgaagatcctgatataagagtctgaaattaaaggaggctgcagataatttagtgatggtgcagttgagggatcattaggcatagtctcctcagtatctctggcccggcagggctagctgtctgaacctgtatttatgtaatctttcaatgagtatctttgggattaaaaaagatacttggtatctgatgaataactttattatttatttattaagatagagtctcactctgtcctccaagctggagtgccgtggagatatcaactcattgcgacctctgcctcccaggttcaaatgattgtcctgcctcagcctcccgagtaactgggattatagatgtggaccaccacgcccaactaatttttgtatttttagtacagacggggttttaccacgttggccacgctggtcttgaattcctgacttcaggtgatccatctctcaaagtgctgggattacaggcatgagccactgtgcctggcctctgatggacaactttaatattaagatcattattttaaaatttatttttatttatttatttatttatttatttatttagagatgaagtctcactctgttgcccaagctggagtgcagtggtgtgatcttggctcactgcaacctccgcctcctgggttcaagcaattctcctgcctcagcctcccaagtacctgggactgcagacatgtgccactatgcctgaatatttttttttaatttatttttagtagagacggggtttcgctatgttggccaggctggtattgaactcctgacctcgtgatccacctgcctcggcctcccaaagtgctgggattacaggcgtgagccacagcccctggccttaaaatttcttaactgacccactgtaaggtaaaatactaaggaaatgatgaacacgcatggctggacaaggaaagaccctggtatgtctgggactagatttgtgatctactctgtattactctgagactacagaggttctaaggaccccagcagtttttaatctcaacttgatagcaatactccattgatttaacattataataggtaggatgcgtctgggaagtatggagaagagagcagaagaagagtgtttgggggtcatgttgtgtaagatggaaagcagagacaaaagaaagggataacaattacccccctgatggtgtatgaaagattcttcatcattattctgatattttccatgtacccacacaatgaacgcacatgtgcacgcgcgcgcacacacacacacacacacacacactctttgcatatacttcattcatgccccataatagtacaggagggtgcagtgatacagtaactttccaagtataatacatcactgtttggaaaaaaacatagctggaaacgtgcatgaaaattacctgggaacgtgtcagaaatacacattcttgggacccatccctgattttgtgaatcagaaactctggggatgagacattttaaacagatttcctacaaagcatttgctcctacattttcatttttaaatctaagacctagttcaaaacccatttcctgcttgaaccctcctctagccccatgacaagtgatccacttcttgacacagaaaacattttatactaaaggaccttataatgcactgtcgtttattgcagttctatttgagcacattttacctcccaggccagactagtaaggaaagtaaaaaagagtaaaatactctttatccatctatctgtctctctgtctgtctgtctatctctttgagatggagtctccctctgtcacacaggctagagtgcagtggcacgatctcggctcactgcaatccccgcctcccaggtttaagcaattctcctacctctgcctcctgagtagctgggattacaggcatgtgccacaacgtctgtctatttttttttttttttttgtatttttagtagggacggagtttcaccatattggccaggctggtctcgagctcctgaccttgtgacctgccccccttggcctcccaaagtgctgggattacagacgtgagccaccgcgcccagcctattcttttatttttaatcttgcataacttctaccttgtggtggatcatattcatatttaagtagttggtatatgatgaatatggagtaaaagttctataatatcaaaatagttgaagttacggttagtgtgtatagtgaatattggctcctttaggctacaaaaaccagctttcacaagtatagaaagaaaatgcatgaaatgagcacttactagagtccaggcatgtgtttagttaaaatgtaaatggaataactgctataaaccaggccccatgtgatatgctggggaaaaatatttcaccagcccctcccaggatatgatctatcacaaaactctgttttgttttgttaagaacgtttgttatcatctcaaattctcatgtggtttaactcattctcttgtttattgtctgcccctttcccaaatccatgagacagactttgtctaatatattaacagttgtatcccaaatgtcaggggcagcctggtacataatatctatggaaaaaaatacttctgaatgaatgaatgacttaaagagtgagtaacattgtgaggaagacgttataaccccatcatagacaaactgagactctgacaacttaagtgacatgcccaaaaaatatagagtctagagtttaaagctcaattctttccaattctaaaaattgcatttcttagctctaccgttcatcttcacatgatttttccccttttaacatatctgtctccagttttttcaagggatcacgggaatttgagctgcagttttttagtactgactgcctgcacttgaaaacttctccaaattgtgctgagctgtgcagttaatcattttcttgagttgaaatgaatactgcaaccttacataccacctgttctcccaataattctggtatatacagccccagcttttggaaacttccttgagaatcaaggaagcagaaagataggattaaggaagcagttatccaatgagttgccagtccagtgagctgacagcaggaaccttggctgtgggctgattttaaagaggcttgtgcaggtgatggagtgaccttgttagtgatattttcttttttatttcttcctgcacattttgctttctgtttattacattgagggaagcagaggacttctgaggaacttcataaagctttttcttttttctaggactccaaatatccactgaatcccttctgttctttttttcattagcttcaaaatattgagtatcagactgttgtaataacaaatccattcagtattcactaatgaagttgtgtaaagataactatgacctggaatttagatggtgaaatgaggggactgtggtcaaatgtattatttatcgttcttcatggagactctcacagggtattggaaaggaaatagccttggtaaacagaatatcctggatttgagccctaattctgccaccattagaaagcactaatctcactaagccagttttttctttttcctgccaaataagattcattgtgattacatggaaggatatttgagaattaaatgagataatgattaatacagccctaaggatcatgcttggcacatagtatatattgcataaatgtatgtcacacattatttttaacatagaataatatgtaatgaatggtctcacagggataatggatcattaattcatcaaaaaccggataggcatgaagctggaatcgatggttcctccggttctgtgtctaggacatgtagaccagattatatggagttttttaagtggactacctactagtgtaattgaatgaggaccatcatggccataatttggcttgtttttactcctctaacagtgttatagttttaattctctgactgtcagcacccactgatctttagcaattccaacagtctatcactaaattctactgtggtccacattcttagtatggacttctactatttctcccattacaggaaagatgatgacttagcttaagaatgtttcctgtaagggagcatgctctgaacaatctgtggtggaaaatggatgtgacatattattaatgttggattgttgcctaaaatgtcttttgatgctataaacatgagattggaagtccaaacacctgggcttaaattccaattctgcacttactattttgtgttatctgagactttcacttgtacactataaataggaccagaaatgcttaactcacatggtaattatgtgggttaaattaaattagataaggtatattcagcccctggaatagtgagaattaacaattggtaatgctttggcttacctccctgaccttgcataaaccatgcatggctgaactcaccctgtccctgcccagattttgcactgttgagattatgaggtacttcctaatggttgctgcagctgcagcccataaaacagctctttgtgtgtatgaagaaaatcataataagaggggcctccagagccatgtcacatctctcaggcagtacagcctctttcattgaatcatatgaatgattaaaccaaaggtgtctgatttgtcttcctgttttatagcagaaacttttctacaggttctggcatcagaaataatccttccactccgaaatttgggaagtattggagataaaagggtatgtttgttgttgttgttgtttgacagagttttgctctgttgcccaggctggaatgcagtggcagtgtattctcggctcattgcagtctccacctccggggctcaagtgattctcgtgcctcaacctcctgggtagctgggattacaggcacccaccaccacgaccagctaatttttttttttttttgtatttttagtagtgatggggtttcatcacattggtcaggctggtcttgaactcctgacctcaggtgatccacctgccttaggctctcaaagtactgggattacaggtgtgagccaccatgcccagctgaaagggtttgttcttgatatgacatttttctatacaaagcctagatagtatggaatggtggaaaaagctgacaaacactaataccaggtgatcaagtgtaacataaacaatgataagggtatgatgacagcacataccctcaatatgatgtaaataagaatggcactttcttctgtgatcttcctccccaaaacatacaaccccaatgtaatctgagagaaaaacatcagacaaatcccaatggaaggacattctacaaaatacccgattcgtgctcctcaaaactgtcaaggtgatctaaaacaataaaaacatgacaatcagtcaccgttttgaggagcctaaggaggcaggacaactaaatctagtgtggtaacctggatgtgatctcagataagcaaaaggatactaggaagacactaaggaagtctgaactaactataggctttagttaataataatgtatcaatattagtttagtctttgtgacaaatgaaccatattaaagcaagatgttagcaggaaaatgtgggtatgcagtatatagggactttctgtgcaatatttacagtggttctataaatctacaactattctgaaatgaaaagtttattttaaaatattatttttcttatttatccttcaaaattctgggtgctcttttaggaagcctaaccttttatgtaatcctataatcccataacttcccactatcccccatcaccatggtttgtatcagccctcctctctagtccttattgcattgtatgaccattttttcacagaactaaatgttcttcaaggacaggtctttaatttccgtatcccagtgcctctcatagcatttgggatagatagatagataaatgtccaagacatagtagaataaatttttaaaaatattgaataaatcaatgttagaacaaataaatgcattttttaatgaattagtaactgaaggggcagaaatattaagcccagcaagtgacatcagctgcctttgtactgatatgatgttgaaaagaacaatgactgagggatctcgccacagtacatttcacatattattgcatcactgatgacataattactgacaagtggcttgtttctgaggggcaaggctctattctgggggttggatttggtacacagatactccttggtgttaagcacaactatttggcctatagacactacatgtgccctgcatgtgagcttcattcactaaatcattcaacaaatgtgtaatggcaatgacaacaataactaccctttattagataattatgtgccatatattgtgtcagatgctgtattgtactaatttcatccatgcaacaaacctgaaatttaaattatcctattttatagatgaggaaattgaggcagatagtttaagtaattttatttaaagggcctatcatgtgccaagcagtggatatataactgaaagagtaggagggaggtactggagaaagaggtggtaagaagtaaaaacaaagtgctagtgatgggcatattgacctagacttttatctaaatgcttgggtcacttatgaccctttctctgtaggaactgaaaaccaaacattctgtagattttcttctaaatctcttattttccttctggaatagaaactctatggtgggtactcaacaaataacaggaagcaacagtgcatctgatatagtacttgtgagaagaagcatattgtgttaaagggttcaagcttggaatcagatacacttggactgaaatcctgggtctgccattagtagctctgttaccttggccattcagcttctgcttccttttttgtaagtgggagttatcattcttctcttgaaaggttgttggaaggattaagtcataggtatcaagtactgagagcagagtaggtatttattggataaatggtaagaggcattttcattacatctgtggagagaagtaaaacacagtagctggtggaaggaggaggtgtgctgaaggccagctttcaatttctgtacattatgctatgccttgtttgttttttaattttgttgaatgaatctgtctcaagaatgacattctcaataaagtttattttgtagggcataaactagtattaacagaagagtctacttatcttctattcattgagcattgctacagactagagccaaggtaatactcagaagtccattagttaaaccttggtggtctgagggtcataccagaacaaggatgcactgatgaatttcatatttttagtggagtcaaacgtttgcttagtttatatatagtttattctatggtgacagaatgttaaagtttggaagggcttgagagctcatcaaatttattcttatatctacctctgtgtagtcataaatgagagaatatgaagaaagcttcttggtgttaatgatagtgctagccttgctacctgtatttggtagttaaaatgtatagcttttctttctacaaacaacttaaagtactctcatcatgtactcccatcaaaaattttgtctgcagatggctattatccagtttgcaatgaaaaactgagtggaaacagtatttactttaggaaaatatcttcctgactgttttatcctatcccactagaggtagaccttagtatgcatatactaaatttcaggagccaacatggtctttattgacttggcctcacaaaagaagcatgcccactaaagtacacccagatgtgtagaaacagccacatcataatggcttactgttatacttgctaattgacaataagaaaatcactcgacttctctaaatgctaatttcatcctttctcaaacaggagataacaattacttttcagggacacttaaataacaacagacagtgtatataaaggattatgcattggttagcaaatactaccaccacaaaatattggaaatgtaatattaatttctttctataagactattattaaagacaacaagaatattgttattcaaagtccttatataaagacatgtcagcataaaaattacttttgaaacaaattttatgaaaatatctgtctatatgaaaaaccattattcccatgcacataacatgtacatatatgtataatgtatatataataaatatgaaagatgaatatatattatatatgttatgtgttatagataagcacaaatatgttttatggtatatataaataaatatatgtataatacataacatatataatggttctatatatttataacatatttatatatagatataatttacatgtgtttagttagttttaccttaacactagaaagctcagcactaaaataaatttttgaatctagtgtttttttccctgtagatcactgatatcttctctttccttccaactgggttttgattgtttcaatatctgcaatctgctctactaaaaaccacatttgatcacttttagaaacagggaggacctcaagtggcaaatatatcatgccttctagatcaggagagaaaacaaaagcgatgaggttaaatgacatgccccctaactcacattgttagctaatggtagagtcaaggtgagaacagccaggtgctgcctggtagtcttccaagctggtttgtgtaatcacactcaaaggtataatgagatatgaaactattttctgtcagataactcttatccatttgggaagcttttctaatgaaaagttcaatgtacatcctccaaagtacttggcacacttcctggaaaatggtatttagtgctacctgggcttttaaaacacacacagaataaagtgtttcactctgtgtagctttggattaaaaaaatgaactggccattgcctgatgaagtatgaggccctgagatatccacgagggcagactaatatccagaaaaaaagttttttttatgagtgactacctgtattacctaaggaatatgtctttaaaaacactgccaacagacacccattgatttcttctcagtcatgatcacttgagtggcaggaagaagcccaataaaacagccagccaacagataccctgcgagtgccaccaaggtgatagcatgtgttacttcacagtgaagggaagcaaaagtagtgaagtgtctgcctataaattttaaattgtgtgatctggtatcactgacttttgtatgagaattcatagtttataaaattatataaggtagcaatcctttgaaataggcttatgaaattttatgagtggatgctcatttcaccaataaaggatttgaagttcaaccaggctaagtgacgagtccaagttcaaataaatattaagttatgtaatatgtaaactcacatccttttgacacctgtgctctttcaatgaaaccatgttatattgtgtttcatatgatttcattgatttatgtaagcagcaagctatggttctaaatagggttctggccgccctatgaatcagccctagtgaaagatggatgagtgcagctcacttgaacacgtacagtgggcactatgcccacaagaagtaggcggtgccagaaccaagcattcaagactaattgaagcaaagcttttaaaatttttaaaaaattatttttaagactttttgtgggtacagagtaggtatatatatttatgggttacatgagatgttttgatacacgcatgcaatataaaataagcacatcctggaaaatggggtatccattccatcaaacatttatcctttgagttacaaacaatccaattgcatttttaagttatttaaaaatatacaattaagttattcttgactatagtcaccctgttgtgctatcaaatagtaggtcttattcattctttctattttgtttttgtacccattaatcatctgtgcctccacttcccagagcccccacttcccttcccagcctctggtaaccatttttctactctctatgtacattagttcaattgaaagaggcaaaaaaaacagccctatctttaggggaaaatgaattgaagtaatagcattgaaaccaagctcagctcagctcagcaaattgtctttgtgcttttatgatgagccggcactgttgagtagtaacacaaattctgttttctgtaccatgtgctgtgatactaatggtcttggtagatctctatgatctctacaattttctttccttaagtagtctaaatttctattaagaaatagaggtggagttactagcaacaattgtgaaaagaaaagggaagatacctgtagtgttgtatttgtgattatgtgtttgtgtgtgtatttgacacatgcacaaacatatatatgtatgtttgtgtatatgtatgtgtgcatatgataatggatatacttgtgactatgtagcaaatatctccagaatacctgacttactgatgttgggcacactgtctcttctgaactagaataaaaaatataagccttaaagattcaagtctttccatacttttcaaacgtaatgtactttgtaagaagtgggaggctacatgaataagtgttacctaatctctaaccactagggattcacttctagtcaatgagcaaggtgcatgctcaaataattttaataactatctggtaggctgtgataagtgctaaaataagattaaaattgttaagggatcacagaagaggtagcattggatttggatttgggttgtaaaaaccatttctcagtagaaatgacatttccctgaacctctaataatgagcagggagttgacatgagaagataaatagctttgacagtttacaactatttttgcactgagaagcaagataattcttccctgatagtagtatggggcaagtctgccctcataaagatttcggagtgcttcaaaatacacagaattgtcaggtgtgagagtgaggcttgacgcctgaatttgtattgttgacttcaccatcaggattctgaccaatatatgatgctcctaatgtgcaatgcagagatccgtaaaccagcttgattcaagccatacatggagaatgaagtagtaccctccctcttcttgtgcttttaaagctataaaatgaaaaagaagttatttgtttctttctaatattctcataaagacaagattatttgtggacatttgttctctgtggaccaagtcaggaacatgagcaaggaaagcctaaatatttcctctaaaatagtaattgacaaatgcagaaaaataacacatatgcttagcttccaatatttgtcatctatcgcattagacttacagaactcttacatgtagcaacacgacgtgctatcttaaagtctgatcttaactgtattacaaagggagtacctatcaactttgtctgcaagatcttagattcagtgaaatatggcaaatagatcataaaaaatttgaaatgaaacagctaatgaataatgaatgttccgttgctatctttgggtaagcgtctgcaaacatatgttttttcagaactttagaggatgttgattttatgcaaactagaaattctctaccatctgtaataggaaacaagttctctgtgctatagctaataatagatagagcactgagtgaatttaggaaactattcaaacggtatgtaatgattccttcacattgttctttagcattgctttcttgctctttgacgatttgggctggctggaatgctgacatggtgaggctcttttaacgttaatgtttggtcaatgtagggccttgaaatattgttcaattttgcgagagctttaagtctatgtctccttctgttcatttacttcttcttcgtattaggacattggctatcaaaggtttctgtgcagcagttcttgattctcttagtggatttgatcctaaagacagaataatgtatgcattcaatgtagagtcataaggtaattatattttttacgcatcatacattttcccaaaaaatacccctatttgcaacaataaagatgaccaaatagactctctcaccatgctaggttaaatggttcagactctgctcacgggagcttgatgtcagaattcgctggattaggccaggatgctctgatgtaaggagtgcgagtcagcttcctcctgctgggcacctacttcattggcatgaggaattcctgctacccctacagatctttatttgcaagtattatatgcagatacattttaccttcatttccgaaatctccatggcaacaaaaagtctactcttactttgctgtttatttttatcttcaatgtcttctcctctgattgtcgattttctgcttctaaattatttgtttcttcttttgtctcttccattcttcactcactccctccattctctctttttcccaccctttttttctttcattgtaattttttgatcattataaaaaatgtatccattagcctatgcattattgctatcagaatgggaaaggatgtaacttgatagttaatggaactagctttggaatcaaggtaatttgaggtcaaatccagaatttcttcccttaatcattctgtgaaacgatcaaatttttaattctccttaaatgcaaatttattcatctatgaaaacatctatgaaataacattgctataatgtagatagattaagagtaattgcatctatataatagcaatcccatgaaggttacataaaataatgtatgcaatgtatttagcagactgtctggcccctaataatcaattcatttaatggtcaagatgctgtaggctgcttcatggttggtggtggtggcagagatcaatttttatgccttatcaagtatatcatctcagtttctttgaaagtacattgcagatttcacgtaatcagtgttgagatgccactatgaatgaaaaggcaattttgtgcaaagctctggttttcagtaatcagttaggattaattcttacttgtggacaagctgaagcattctttagcagctcctgccaacttctctgtaatatagacattttcaactagacaccactgaactaataatgaagatgtcgtctcccttataagttattcccacgatattcacaactgttttagcctgaacattttgatgaatagacctatttgttttaaaattgtttcttaaaatccctccaccatcaaaaaaattcaaattaatattgcaataccatgttaaaataagattaagaaacctccccgtaagttaccgaaagtaaagctcatgaagaattacagaagttttaaaagaaaaaaaagaaaacgaaagaaaaaagggctagtgcattaggaaaattaagcagatgcactatgaacattaattacagctaactgaggttttgtttactgaggttagcagattctaactcattgagtttccttagaaaatggcctgagttatccttgcaccataagttaataaagaagcagatattatttctctctacaaatggaaccacattaaattaaatatagcttttcttattactcttttggaaagcaaaggagtaagttacctagagtccatcaggatgcctcagaccactaaggcttctcattttctcataatcatgtgccatcctctgcagatactagctttgcttttgcaagctcatggtgtggcttaatacatatggcaccatgacatggtcagttgaggagggaaaggaaggaagaaacctatgttctaataactattctcccattatccagttgtatggttctccacagtcactttggctctctgtgtttccacttagtcatctaaaaagttgtttatatcaataatttttaaacttttaacaattataactccctttaagaataacatgttgtctataattttaattggcataaacatgaaattttcacaaaatacagctatatatcattttaacaattctgtgccaccctaaatcccttacagttgcatgaattgctaggctaaggaccctaatctaggtggccacatgataccttcataattctgtgatccttgggcatttaaattccttctcaaatagcttatactcatagggtttattgggaagcaggggttatgtatattttacacattctctagctctgaatttgctgtaagatttgaccaagttacacagtttctgtgggccatgtttatagggtagtgtcatgataaaatcttagactttggaatccaaaagatctcaatgcaaatcatggttacgtcatatattcacactctaactttaagggagagtattctgtgggcatgcttttattgcatataatcgtgtataataggccatgatcttaagactttgaaaatttacatttaataatcatttgctcaatatttgcctcaatcctttgtaatgtatatggccatatacatgtgtacatatatatatgttaatatacatgtatacatataatatataactatattatatataatatgtgtgtatatacatatgtggagtttgtagctaattgatgtttcaatttaaatatatttattacaattgtaaacattttgattttgtgtgtgttttttttttttttttttttttttttttttgagacggagtctcgctctgtcgcccaggctggagtgcagtggcgcgatctcggctcactgcaagctccgcctcccgggttcacgccattctcctgcctcagcctcccgagtagctgggactacaggcgcccgctaccacgcccggctaattttttgtattttttttttagtagagacggggtttcaccgtgttagccaggatggtctcgatctcctgacctcgtgatccgcccgcctcggcctcccaaagtgctgggattacaggcgtgagccaccgcgcccggcctgattttgtgtttttattttatggcttagagatcattgcttttagatcttaaacactttttgtattctgcacaatttcatacatactttattatattacttaatgaatataatggccaatatgtgagtcctagttttctcatctgttaacttgataatcttgggtaaattcctctgtttctctgagctttaattttctcaatggtctgctaagaaacttaggtcaattagtggttaaaataaagctggatgtaattatctaattttcaattccttttttcaaaattgaaattagctcattaaacttgaaaaggttaaggaataccaaagaaggaaaagaggtatgaataaactctgtgtaattacttgatttacaatttagtgacattacatcttggtatgctaatatgtcaacttacctttgtgttaacaaatttattcatttatacacttaaaattaacttataaaacctttgcttatcttatacatcttaaggttttttatttttatttttaggtagagggacaaagaaggaagagatgcgtaagagggatcagacattgatgttatcttttatgaggtgtgtaaaacaatagggctaaaggtaaattaggctcctaattagttgtaagtaaaaagttatcacttgtcagttatgtttttaaaattatgctaaaatgcccttaattaagaaacaaactaaaggaataacagaggcaaatgaaaatgcaagaatattcttcaaaaacttatgcatatttattgttccttctatcttctaaacatgatttttcttgattgccttttactgtaaatcattacttatggatggtaatcgtatttgtagtgtaatgtgaagaaacatttttttcatgagtttgaattagaaatagcagagtatataaagacagtagagtagaccaaactattttctcccacataagtgcctagtaatgaaattttatactggagaacttaaccttacgatgaaaccagtaacaacatgattgtgttctttgagttcaattataacaaaagtactaacaactagtgaaccatcacttatcatagttttggatatatatactattatcaaaatcaaatttagataaccttgatgtctatagaaacatagccatgaagaataacattttagatgcataaatacagactgtgtggtaaaacaattttgcaggaatagtccttgtctatttacatataatggagagaaataacaccagaggaaatttatgatttatgatagagatctgagcatacttaaatttaattttattttgaatatttgcttgataatccagctaaccatgtcttttattttggttagtaaagtaaatggtttaagtagtaaacattatatatccttgaatttacatgtcagcactgcatacgaattctttccagcataggttttcaaagaagaaattttggtccaaagagacttttttcatctttatgccatactgttttttcacagtttccttttaaatcaagactcagaaaaaaaacatataattgtattacatatttctcctcttacaacaaagatagtttctttctgagtacatacaatggtattgaagtttggaattcaaattttaagtattatccaggactgtgtttctttatttgaagttatattatagatacattaatattgtgagtgattaaacaaggaatgaaaggttgccactttcaccaatcatgtgaaattattaatgacacagcattaaacacaggaagattagaaaactacagaaactgaggattcacagtcttcattcagtactttcttttacttctcaccttgatttcataagagtcttctaactgccctccctgccttcacttcatagttgtaattaattctgcattctgctaccagaggttcttaaacattgagctattcatcatgcccttctgcttaagcccctttaattcttcctcttatacacttggataaaacccgtatgacctaacaaggtataaaacaaataaacctttattacctatctagtctctttgtacttcccccagcatcacttttctcccttcttgtcttgcatctatgctctatttataaaaaccctaaacataaaatagcagcagaatgataatggcagtaatgaaaatcactcttgttgattgattattaataatgtgaccaatcactggatttgaagtttcatctattcctccactcaaaagatgcccctgaacacatactatatacttggcactaaacttagcagagagatatgctgacatgaaaagaacagtggtgttatagtacaagaaaaagcaaatattcactactctcctggggtcatggtctggttggaaggatgcaaattatcacttaacaaatgcaaaattttgtctttgttgtgtgctaaaaagtaaaggaagcaagtcctgggagatcctatgataggggcatgtggcctaataaataagggtgggataggcacacttgatgcaagattttaaaaatgatttgggccgggcgccgtggctcacgcctgtaatcccagcactttgggaggccaagacgggcagatcacgaggtcaggagatggagaccatcctggctaacatggtgaaaccccgtctctactaaaaatacaaaaaattagccgggtgtggtggcgggcgcctgtagtcccagctactcaggaggcttgggcaggagaacggcgtgaacccgggaggcggagcttgcagtgagccgagattgcgccactgcactccagcctgggtgacagagagaatctgtctcaaaacaaaacaaaacaaagcaaaacaaaacaaaacaaaaaagatttgaaattatataggcaaagtgggagaaagaggaggacaaggacaaggtaaaggtaatatgcaaaatacaaatagcaggaaggggcatggatatgtgtaaactcaaagaaggccaaagtggctggtgcacagagagtgaggaaagcaaggcgtgaaaatgactttagtgagacagtcaggggacaaatcatgaatgatctgttagcccatcattaataatttggttttaggagcaatgggaagtcattgggggcttttaagtggggatgtgacttgatctggtgtgcatttaggttcttcagcctggatggtggagaatgggttaggagcaggggtccaggtggaagcagggagagagttagagttaatgactagagtccaaaagaaaggaagactgtcagctcatttggaaatagtgggtataaaaagaaatacttttctgaagtaaatgcataacttatctcatttaagcctcacaactatggcagggtagatattatgaatctcacttttcagatcagtactttgaaacttagataagttgtatcaatttgcttagtcctgtggcagtatatggcatagccaggccacggaaaccaggttctttaattataaattacgtcctctttctgctatactgttctctttccgtattctgcaacactgtgctttttacatgttataacttttcatttgcttttttctcaacttgaaatacgcttccattgtttcaaacccctggacgcctttttcaacgactgcccctttatgcttccggtctttgctaatatctgtcctttgtgctttcatagcacattttgttatcctgttgttttattctttctctactagactgcactcttaaatacaaggaatagggcttttatttgtatagttccaatacctagcaaaatgacaacaatatggtaggtgagcaacaaaatttaaattaaatgaatgcttgtgataaccatttaaatcaagccctcaaacattccctgtatccttcgtacaacatttctggccaatgatcactgaaggcatccaccgttacattactggtaataccttactgatcacctcctaaatgccaggcacagatataaatacttactaatttgccatatttaatactcgcagaatctctaaaaatagatatattatagctgaggaaaaaccgagtaacttatctaaggtaacatactccagaattcaacattaaaggcattctgaatccagagatattcgatgtagattataatatatccattcccattactgttacctttgtttggccctttataactatccattgttagacggaaaattacaccttgactttcctgaccctagcttgacaaattggatattttctccaagccaagccaaactaatacaagcaagtggttcttcctgactcctgttatttctgctctttccaattccttcccgatatgaaatgtatagcctgcttttattacacaatgtaataaatttgtcaacttctgcttaaataaggagtctttcaacaagctctgacaacttcaaatttctttctttcatacttacatttaaacacataaaatttagtaaaatattttaaaaaccagttgcagaatcttacttgtcagcataaatccaaagatagatttcatctatgtaagagttttgctaagttggtcctgctcccagctgtgaaatcccatagtcagagaagtcagtaatgtcctaagcctagaggcagtctggtctgccaaaatgtattccagttttggaggtggaatcattgagttttcaattgcatgtaacccatatgctgtttttcctggttttagagttcttgattagactgaggaacgaagaagagctctgtttgaaggacagtgtctttaaatagaagacaggcttctagtctcaaaaacataaatatttcatctatttgcatatgggattaaataattgtagatttaagttcatgtaatcaaattccctttctcaccaaccttgcaaatgacttcctcagaaatgcttcagaaagaggaaaataatttttagtaagataagtaacttgcccaagtcacaaagctacatttcaaatgtagatctaaatgattccagagcctaaattcggaactatttagatcttaccttgtgcatgcccactttcaacatcttaggactgctaaattttttctttttgtttcaggttaagcattctcaaattccataagctttccttatataatgtgcccaaactttgtactcaccagtggtccccaatcctgcttagtaagaaagtattttaaagaaggaaagctctttgatccaagtataagagatttttgacagagataatcaaatctataataatttgagaagttcaatgtcatttaaattccagcatataaatgtcaatattagagacttttaaaatattatttgtgtttaataatctacccccaataaaatcatacagcaaacaatttaaacttgaatgaaatgaaaaacctaccttagacatctctcttataatttatcatagaggataatagatcatttggtccagcctcttgcatttaagagaaagttgttaagtattcatttgaaaacatagcatttagtacctattaatttgcgaagacctctgctatttgatttattttgaattatacctcttcaacaccctgaactccaataattctttgatctcaaaaggatctacaactcactattgatcttgcctacccttcaatgttcattatccttcttaagccttcactccgaccttattcagcttatatttccagttcagctttagaatcacttattgggatatctctatattcccttgtacatgtacctgccaccatacttgactggagcaactccagctttggctaattctacctgtctgcctaatttacacctgtgcctgggccactcaacagggctggatcaaacacaaaacactactgactggctttacttaaatttattatcacaaaccttatatagcttcaatttacttctggccaataccacaactacattttattcatcaatttactctcccactctccaaaataataataataagttgtttaaatgttcaaagacggggtcttagcagatttcctttaaaactcatcctagttttataatttaaaaagcacctttaaaaatttgccattaatcttttaagacttggttcattgttattcttagagttctccaggccatctagctagtcctttttccatgctttaagaatccccattttttgcattcatctcaatgcatgctatattacattgcttttaaaagtttttctgtttatttatcttcccccctcaccctgctctctcttttaaatggcattccctcattaggtaattagattcctaaggataagagtttcaaggactgtgctgtgttttgtttgtttttatatcccggggtttttcaagaagcccggcactatatcccatattgtactgcggttatccgtccggttttaataccttcctctcaccccaactgcaatattttcctccacagtgagacctgtgagagcaagggttgtgtagcatgtagttgattccactgctagaattatgcctggtacattataaatagtaagcaagtgtttgtagaaagcatagcaaaccaagaaaaacgtaagttcttccatttaacatgtttttgttgagcatatattctgttcttgtcatgagaaaaatttttgggatagtgcagtgaacaagaacacaaaaaaaatcctataaaggaaatgtaaagatggacactaagaaaagtaaatgaaccctaaaatgtgttagagcaagataggctaaattgaatattagataaggttctctgggtgagccttactgagaagaggactttagagcaatgatctgaaagagatgaaggtgctccctaggtggctctctgggggggaagcattctgagcagtgggaatagtgtggcatccttcataaaaatggaagcctttggagggttttgaacggaaggatgaggttctctgatttatgttaaaatacacaagtgaaaatacaggagaatataatcagtggtaaaatgtcctgcaatagattattaaacactcatctctactggttctgtgctttagtagtaagtgacccatgcaaagtaaaagttgcccttgttgcagataacatatttagtagatgaataaatgaactaatgaacttgaatgacaggttgccaaggggataacctatcaggattcattacaaaagaggcttgtctttatgtgggaatcaggggcaacaaatctagttattagctttggcagcctcttatttttgagttttttttaggaagccagagctcccaaacaggattcttctgtgcactttatctaatgttcttgaataacaaaatcagtgcatatccggtttgctaaatatatccactagctctttccttgatgcaaataacttacacattttaataaaagcatgttagctctttgttatgactttatttaaagcataatcctctggaattattaattaccattactttggcatgttacatttttcttagcctagatactgtttggaaaacatgccaaaaatagttaaacttaaaatagaaatatgttcaatccaagaatcttagaagacaatatgagctccaggcattcactttatgtccttccacatgccttttaaaatgttgttatcaaccatatttccagctctctagggggagaaaatagctcacatataagaaatgtaggtgctttttgttttagtataagtaaaaattacgcttcagttagagcattaagaacaaataagatttagtatttttgttttaaaaatgacagtctgtttaaaatatatgtaccttgtttttgttgacataattatgattaatgtgatatgacagtcttcggatgacatttttaataagccaggttgctgatgttaggacccttttatagtaaaccctttattttgagataattgtagactcacatgcaattgtgagaaatatatagagaggtctcaaatactctttaccagtttttcctcaaatggtaaccttttacaaaactatgtacaaattatagccagtgtagtgacactaatacagtcaagaacagagcagctccaccaccacaaagatccttcatgtttactttttagagcattcacttccctacccactacgtccctgacccctgacaaccactaacctgttctccattcctataaatttgtcacttcaagaatgttctataaatggaactatacaaatatgactttccgggtttggctttttcacttagcattattctctggtgatttatataggttgttggctgtatcaatatctctgtcccctgatatggatataccatccactgaagtttaaacattgaccaattgaaggatgcctgatctgattctggtttttgattatgacaaataattctgctgtgaacattctagcactttttgtgtgtgcaagcagaagttttcatttctctaggataaatgcccaggagagtgattgctgtattgtatgatagtggaaaatgtagtttggcaatttttttttccaccaagaaaccttaacattgtctcctggagttatgtaaaataacctagcaggttattttacattttcatgaataatgtataaatgactggtggtggttttatttatttatttatttatgttctcattttagccatcctgctaagggtatagtgctatctcactgtggttttaatttgcatttccctggtggccaataatgttggaatttttttatgtgcttttttttcatcagtatattcccttcagtgaaatgtctgaccaggactttgcccatatactaatgagcattctttttaaacattgagttttaagtctttctatattctagatagtaatcctttgttcaatacgtggtttgcaaatatcttctcccagtctgtagcttattttttgttgattttctttaattcttttagggtcttgtacagagcagtttttaattttgttgaagctctatttacaatttttttccttttattaatcttgtatttggtgtcaaatttaagtgctctttgcctagtccaaagtcatgaaaactttgttctattttttcctaaaattttaaaataatttcaagttgtacatttaagtccatgatccagcttgaattatgaggtttagattgagattcgtttcttttttctttgcccactgatgatgacttactccaatatcacttattaaaaaggctatgaattgaattgttttaatacctttgtcaaaaatcagttgggcatatttatgtggttttgtttctgagttttttgttccattccattgacctgtgtctgttcctctgccagtataacatattgtggactattgtaattatataataaaacttgaaaccagggagactgacttatttttccttttcaaaattgtttagctagtctagttccgttttttaattattgttatactttaagttttagggtacgtgtgcacaacatgcaggtttgttacatatgtatacatgtgccatgttggtgtgctgcacccattaactcctcatttagcattaggtatctctcctaatgctatccctcccccttcccctcaccccacaacaggccccagtgtgtgatgttccccttcctgtgtccatgtgttctcattgttcaattcccacctgtgaatgagaacatgcagtgtttggttttttgtccttgcgatagtttgctgagaatgatggtttccagcttcatccatgtccctacaaaggacatgaactcatcattttttatggctgcatagtattccatggtgtatatgtgacacattttcttaatctagtctatcattgttggacatttgggttggttccaagtctttgctattgtgaatagtgccacaataaacatacatgtgcatgtgtctttatagcagcatgatttatgatccttcgggtatatacccagtaatgggatggctgggtcaaatggaatttctagttctagatccctgaggagtcgccacactgacttccacaatggttgaactagtttacagtcccaccaacagtgtaaaagtgttcctatttttccacatcctctccagcacctgctgtttcctgactttttaatgatcaccattctaactggtatgagatggtatctcattgtggttttcatttacatttctctgatggccagtgatgatgagaaatttttcatgtgttttttggctgcataaatgtcttcttttgagaagtgtctgttcatatccttcacccactttttgatggagttgtttctttcttgtaaatttgtttgagttcattgtaggttctggatattgttagccctttgtaagatgagtaggttgcaaaaattttctcccattctgtaggttgcctgttcactctgatggtagtttcttttgctgtgcagaagctctttagtttaattagattccatttgtcaattttgtcttttgttgccattgcttttggtgttttagacatgaagtctttgcccatgcctatgtcctgaatgatattgcctaggttttcttctagggttttgatggttttaggtctaacatgtaagtctttaatccgtcttgaattgatttttgtataaggtgtaaggaagggatccagtttcagctttctacatatggctagccagttttcccagcaccatttattaaatagggaatcctttccccatttcttgtttttgtcaggtttgtcaaagatcggatagttgtagacatgcggcattctagttcctttacctttccatatgcattttagaataatcttgtctatatatagaaaaagcctgtatactttgtagatttatacaccattttttagtgattgtaaatggtaattttttattttcaatgtccatatgctcattgctagtatataaaaatacatttgatttttatgtttatcatgaatactgaagctttgctgaactcacttgtcagttttaggagtatttttgtagattccttgggattatctatttagactgccatgccatctcctaatggaaacagttttattgcttcatctctaatcttagttttacctcttatttacttatattgcctgttgcactggctagaacatctagtgctattttgaataatgggaagattggtcagccttgccttgttcctaatcttagactaaagcatttggtctttcaacatgaagtataacatttactgctggttttttggagatgctctttatcaagcatcaagctgagtaatttctctctattcctatattcctgagagttgggttttttaaatcaatgaatttatgttgatttttatcaaatggtatctctgcgttcattgatatgatcatgtcatatggtatattacattgattgattttcaaatatcactccaacctcgcatccctggaataaacaccacttggtcatggtgtataaactgctgaattcgtttttatgtactgctgaattctacctaataatattttgttaaaaacttttgtggttatatttgcaaggtagtttctccctccctccccctcttccttccttccttccttctttactgctcgcttctcctctctctctctttactatttttcttctctctccgcctctcatatttttcttctcctgccccctctcatttttttttgttattagttttcataccagggaatactttctttggttttggtatcatgaatgtactatattcataaagcatattgagaagtactccctactcttctcttttctgaaagagaatgtataaaatatatttgaactcttccttaatgcttgataaatttctccagggaaatcatcctggcctggagatgacttttttgagtttacattataaagtcaatgttattaatagttataggatgttgaagttatctatttatatttaagtatttgagtaaattgtgattgtctatgcatttcatggaattgattaatttcctcaaagttttcaagtatgtgtttgtagcgctatttgtagtatccccttactattcctttaatatttgaaggctctgtattgatgttgcacatttcagtcatgatggtggtaattcatgaattcatgtcctctctctctctgtctcatttttttcagtcttcttagaggattgtcaattttactgatttttttaaatgaagtaactgattttctctattttttattttcaagtttattaatttttgttattatatttattattttctttctgtttgctttgcatttattttgctctttcttttgaggtggaaagtcatgctactgatttaagatttttctcttctttcattctttttttttttttttttaattttgagacagagtttcactcttgttgcccaggctggagtacagtggcgcaatcttggctcagtgcaacctccgcctcttgggttcaagtgattctcctgcctcagcctcccaagtagctgggattacaggcacctgccacaaagcccagctaatttttttgtatttttagtagagctggggtttctccatgttggccaggctggtcttgaactcctgacctcaggtgatctacctgcctcagcctcccaaactgctgggattacaggtgtgagccactgcacccatccagagattttcttcttttctaataaaatcatttaatgctattcatttctcagcactgtgttagctgtgttccacaaattttgttatattgtcaacttagttcaatgatttaaaaaagttctatcttgatacttcctttttagcatgtagattatttagcagtgtattgtttaatatttatgtgtttgagattttcttggtatctttctgttactgattatgttttgattccattgtggtcaaacaacacattctgcatgatttcaagtctttcaagtttgttgtggtttgttttctatcttagtgtatgttccaaaggcacgtgaaaaagaagaacgtattcttctcttggatggaatgttctataaatgccaattagatgttttactagatatgtttgtctatatccttactgattttatgtctagttctgtcaatttttgagagcgtggcatggaagtaccccactaaaatgtggttttgtccctttttcttttaaattgtatcagcttttgcttcacattactagaagatttgttgttggttgcatataactttaggattgggttgtcctcttttttatcattctgtagtataatgacctgatgtatcatcattcaaatttgacaagtaattagttgcagccatagatagtgtcagaattgttataacttgatttgtgttgcatggcttatgaagcccaagtacaccaaataccatttcttctcttcagaagtgctcagagatgtcctttggaagtttatcagtattgttcttctccaaaggaagaacatatttctcatggatttcagagataaagacacagctgtaatcaaattgtgtgtatggaaaataggccattttgtagtaaaattatcccacagggtttatcatgctgagttgaactgtgaaactaatacgttgggtgataattaaaactgtcctaaaaaacgtgaagctgtaagatctcatacaagcatacatttactttgactagcagctatatactcttgtttctctgtgaggtttttcttttttttttcttttcttttttctttctttggttatggttttgatgaccatttctgagggagatgtcaatttctggaaagtctttggatgaaggattcaggtgaggaaagcagccatatggttcttcctctttccatgcccagagccccaatatgtaatcattcttcttatacatttgtagatattttatttggaatttcaagatttgagttttgctgggtacccttcacatgtctgatacaacctatataccatttttcaatcatatcattagaaatgagaactgatatttagaaaatgtcaaatgatttacatcctacagattgcagcagccatcatagttgtcaagtccagagaatctttaattgtccttgcccaagaatatattctacaacattggtgcacaccacttcagtaccttataccatgtacttcactggccttttttttttttttttttttttttttgagatggagtctcgctcttgttgccaggctggagtgcagtggcatgatctcagctcattgcaacctctacctcccgggttcaagtgattcttctgcctcggcctccctagtagctgggactacaggtgcctgcaaacacgcccggctaattttttgtattttagtagagatggggtttcatcatgttggccaggatagtcttgatctcctgaccttgtgatccacctcccttggcctcccgaagtgctgggattacaggcatgctccaccgtgcctggtcactggccttattttaactcatatgttcacttttgctctgtacaaccaattcttgctggatctcttatttcatatcttgttacatgtggatgctataataactgtctcctattctctcctcaaattactctatgatttttaaagcttagtttcagtatcatcattgttctgggaatttttctaaccaggctcatgctcacaattctcaaagtttaggagctctacagctagaccattttgctcatttctttatctccagggtttggcaatttataggtaagtaataaacattctttaaataatttcattttagttatggttatgggaaggaatgaaagcataggtaaatgttatgaggataaactaagaagcaagctataggtgaagcattccctaaaacaattaagataactaaaaccataatgtacagtaacagggaagctctatagatatcaatagaacttcaacccccaccagtccttggatcttgatcttatggaacctcatacatacttgagacaatgattttgtaaaaaaacaaaacaaaacaaaaagaactttctgatataaagtaaattaaaatcttaatctgagttaaatccaaatcatcccaggaacaccaacaaagtgttttactgtttttttttttttttttctgtaatgctttaattcagtggctttcaaagaatgaccatggctaactctgctgtctccaagattctctcagaggattcacaatgtctatattattgtcatatcaatactttgcagcaattgtaatatatatatatatatatatatatatatatatatatatatataatcagttaaagtgataaataataataatgggtttttgtgtcaggcaccctaccaggtacttaaaaatactttctctctttttgtgaaaaatgctattggaattttgatagggattgcatttaatgtgtagattgctttgagtaatattaacattttaacaatattaattcttctaatccatgaactcaggatatctgttaatttatttgtgtcttttttaaatatctttcatcagtgtctcattgttttccttgtatgtatcttctacctccttggttaaatatattcccaagcatttaattctttttatagtttattctattttaaataagattatattcttattttttttgggggggatggttcattgttagtaactgaatgctgctgatttttgtatattgcttttatattataaaactttactgaggttggtacagtgctttgtatcagtaatcccagtactttcggaggccaaagcgagagagttgcttgagcctaggagcttgagaccagcctgggcaacatatggaggtaactacaaaaagtcaaaacaactagttgggtatggtggctcaagcctgtcattccacgtactcaggaggctaaggtgagaggatcacttcatcactgcatctcagggctacagcgagccatgattacatcactgcactccagcctggacaacagagtgagaccctgtctcaaaaaacaaacaaactaaaaacaccagaaataaaaccagaaaaaaaatttactgaattcatttatagttctcatatcttttcagtggggtctttagggttttctatatataatattacattacctttacacagaaacagtttgtctttgagaaccaaaaaagactctgaatagccaaagcaattttgagaaagatcaaagctggaggcatcacattccttgatttcaaactatattacaaagctactataatttagaaagtatggtactcagttcaaaacagacgtatttactaatagcacaaaatagagagcccagagttaaacacacatatatggtcaactaatctttaataagggtaccaagaacacacaatgatggaagaaaagtctcctcaataactgccactgggaaaaatggatatccatatataaaagaatgaaactggacacttgtctttttttttttttttttttgagacagagtctcactctgtcctccaggctggagtgcagtggcacaatctcggctcactgcaagctctgcctcctggactcacgcccttcttctgccttagcctacggaggagctaggactacaggcgcccgccaggatgcccagctaatttttttgtattttcagtagaggtgggtttcactatgttagataggatgatctttttttttatttattttttatttttttattattttatttattttatttattatactttaagttctagggtacatgtgcacaacgtgcaggtttgttacatatgtatacatgtgccatgttggtgtgctacacccattaactcgtcatttacattcggtatatcttctactgctatccctcccccctcccccaccccacgacaggccccggtgtgtgatgttccccttgctatgtccaagtgttctcattgttcaatccacacctatgagtgagaacacgtggtgcttggttttttgtccttgcgatagtttgctgagaatgatggtttccagcttcatccatgtccctacaaaggacatgaactcatcattttttatggctgcatagtattccatggtgtatatgtgacacattttcttaatctagtctatcactgttggacatttgggttggttccaagtctttgctattgtgaatagtgccacaataaacatacatgtgcatgtgtctttatagcagcatgatttataatccttcgggtatatacccagtaatgggttggctgggtcaaatggaatttctagttctagatccctgaggagtcaccacactgacttccacaatggttgaactagtttacagtcccaccaacagtgtaaaagtgttcctatttttccacatcctctccagcacctgctgtttcctgactttttaatgatcaccattctaactggtatgagatggtatctcattgtggttttcatttacatttctctgatggccagtgatgatgagaaatttttcatgtgttttttggctgcataaatgtcttcttttgagaagtgtctgttcatatccttcacccactttttgatggagttgtttgtttctttcttgtaaatttgtttgagttcattgtaggttctggatattattagccctttgtcagatgagtaggttgcaaaaattttctcccattctgtaggttgcctgttcactctgatggtagtttcttttgctgtacagaagctctttagtttaattagatcccatttgtcaattttgtcttttgttgccattgcttttggtgttttagacatgaagtccttgcccatgcctatgtcctgaatggtactgcctgggttttcttctagggtttttatggttttaggtctaacgtttaagtctttaatccatcttgaattgatttttgtataaggtgtaaggaagggatctagtttcagctttctacatatggctagccagttttcccagcaccatttattaaatagggaatcctttccccatttcttgtttttgtcaggtttgtcaaagatcacatagttgtagatatgcggcgttatttctgagggctctgttctgttccattgatctatatttctgttttggtaccagtaccatgctgttttggttactgtagccttgtagtatagtttgaagtcaggtagtgtgatgcctccagctttgttcttttggcttaggattgagttggtgatgcaggctcttttttggttccatatgaactttaaagtagttttttccaattctgtgaagaaaggcattggtagcttgatggggatggcattgaatctataaattaccttgggcagtatggccgttttcacgatattgattcttcctacccatgagcatggaatgttattccatttgtttgtatcctcttttatttccttgagcagtggtttgtagttctccttgaagaggtccttcacatcccttgtaagttggattcctaggtattttattcctttgaagcaattgtgaatgggagttcactcatgatttgactctctgtttgtctgttgttggtgtataagaatgcttgtgatttttgtacattgattttgtatcctgagactttgctgaagttgcttatcagcttaaggagattttgggctgagacaatggggttgtctagatacacaatcatgtcgtctgcaaagagggacaatcagacttcctcttttcctaattgaataccctttatttccttctcctgcctaattgccctggccagaatttccaacactatgttgaataggagtggtgagagagggcatctctgtcttgtgccagttttcaaagggaatgcttccagtttttgcccattcagtacgatattggctgtgggtttgtcatagatagctcttattattttgaaatatgtcccatcaatacctaatttattgagagtttttagcatgaagggttgttgaattttgtcaaaggccttttctgcatctattgagataatcatgtggtttttgtctttggctctgtttatatgctggattacgtttattgatttgcgtatattgaaccagccttgcatcccagggatgaagcccacttgatcatggtggataagctttttgatgtgctgctggattcgttttgccagtattttattgaggatttttgcatcaatgttcatcaaggatattggtctaaaattctcttttttggttgtgtctctgccaggctttggtatcagaatgatgctggcctcataaaatgagttagggaggattccctctttttctattgattggaataatttcagaaggaatggtaccagttcctccttgtacctctggtagaattcagctgtgaatccatctggtcctggactctttttggttggtaagctattgattattgccacaatttcagatcctgttattggtctattcagagattcaacttcttcctggtttagtcttgggaaagtgtatgggtcgaggaatttatccatttcttctagattttcgagtttatttgcatagaggtgtttgtagtattctctgatggtagtttgtatttctgtgggatcggtggtgatatcccctttatcattttttattgcatctatttgattcttctctctttttttctttattagtcttgctagcagtctatcaattttgttgatcctttcaaaaaaccagctcctggattcattaattttttgaagagttttttgtgtctctacttccttcagttctgctctgattttaattatttcttgccttctgctagcttttgaatgtgtttgctcttgcttttctagttcttttaattgtgatgttagggtgtcaattttggatctttcctgctttctcttgtgggcatttagtgctataaatttccctcaaagcactgctttgaatgcgtcccagagattctggtatgttgtgtctttgttctcgttggtttcaaagaacatctttatttctgccttcatttcgttatgtacccagtagtcattcaggagcaggttgttcagtttccatgtagttgagcggttttgagtgagattcttaatcctgagttctagtttgattgcactgtggtctgagagatagtttgttataatttctgttcttttacatttgctgaggagagctttacttccaagtatgtggtcaattttggaataggtgtggtgtggtgctgaaaaaaatgtatattctgttgatttggggtggagagttctgtagatgtctattaggtccgcttggtgcagagctgagttcaattcctgggtatcctttttgactttctgtcttgttgatctgtctaatgttgacagtggggtgttaaagtctcccattattaatgtgaggtagtctaagtctctctgtaggtcactcaggacttgatttatgaatctgggtgctcctgtactgggtgcatatatatttaggatagttagctcttcttgttgaattgatccctttaccattatgtaatggccttctttgtctcttttgatctttgttggtttaaagtctgtttcatcagagactaggattgcaacccctgcctttttttgttttccatttgcttggtagatcttcctccatccttttattttgagcctatgtgtgtctctgcacgtgagatgggtttcctgaatacagcacactgatgggtcttgactcttcatccaatttgtcagtctgtgtcttttaattggagcatttagtccatttacatttaaagttaatattgttatgtgtgaatttgatcctgtcattatgatgttagctggttattttgctcattagttgatgcagtttcttcctagtctcgatggtctttacattttggcatgattttgcagcggctggtaccggttgttcctttccatgtttagcacttccttcaggagctcttttagggcaggcctggtggtgacaaagtctctcagcatttgcttgtctgtaaaggattttatttctccttcacttatgaagcttagtttggctggatatgaaattcttggttgaaaattcttttctttaagaatgttgagtattggcctccactctcttctggcttgtagggtttctgccgagagatccgctgttagtctgatgggcttccctttgagggtaacccgacctttctctctggctgcccttaacattttttccttcatttcaactttggtgaatctgacagttatgtgtcttggagttgctcttctcgaggagtatctttgtggcgttctctgtatttcctgagtctgaatgttggcctgccttgttagattggggaagttctcctggataatatcctgcagagtgttttccaacttggttccattctccccgtcactttcaggtacaccaatcagacgtagatttggtcttttcacatagtcccatatttcttggaggctttgctcatttctttttattcttttttctctaaacttcccttctcgcttcatttcattcatttcatcttccatcgctggtaccctttcttccagttgattgcatcggctactgaggcttctgcattcttcgcgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaagtcgttctccgtccagctttgttccgttgctggtgaggaactgcattcctttggaggaggagaggccctctgctttttagagtttccagtttttctgttctgttttttccccatctttgtggttttatctacttttggtctttgatgatggtgatgtacagatgggtttttggtgtgcatgtcctttctgtttgttagttttccttctaacagacaggaccctcagctgcaggtctgttggagtaccctgccgtgtgaggtgtcagtgtgcccctgctggggggtgcctcccagttaggctgctcgggggtcaggggtcagggatccacttgaggaggcagtctgcccattctcagatctccagctgcgtgctgggagaaccactgctctcttcaaagctgtcagacaaggacatttaagtctgcagaggttactgctgtctttttgtttgtctgtgccctgcccccagaggtggagcctacagaggcaggcaggcctccttgagctgtggtgggctccacccagttcgagcttcctggctgctttgtttacctaagcaagcctgggcaatggcgggcgcccctcccccaacctcgctgccgccttgcagtttgatctcagactgctgtgctagcaatcagtgagactccgtgggcgtaggaccctccgagccagctgggggatataatctcgtggtgtgccgttttttaagcccgtcggaaaagcgcagtatttgggtgggagtgacccgattttccaggtgccgtgggtcacccctttctttgactaggaaagggaaatccctgaccccttgcacttcccgagtgaggcaatgcctcaccctgcttcggcttgtgcacggtgcgcgcacccactgacctgcgcccactgtctggcactccctagtgagatgaacccggtacctcagatggaaatgcagaaatcacccgtcttctgccttgctcacgctgggagctgtagaccggagctgttcctattcggccatcttggctccttcccccgataggatgatcttgatctgacctcttgatccacccacctcagcctcccaaagtgatgggattacaggcatgagccaccatgccaggcctggactcttgtcttacatacaaaaattaactagaagtggattaaagacttaaatgtgagatgtgaaaacataaaacttctataggaaaactagaaggaaagattcttgaaattggtcttcccagtgatttttgggggaggatatgataccaagagtgcaaaaaaaaaaaaaaaaaaaagcaaaaataaactcatctgactatattaaaccaaaatttctgtacagcaaaggaaacaagcaacaaaataaaaaggcaacctatggcttggaagaggatatttgcaaaccacatatctaggaagggtttaataccaaaaatgtgtaagggacccatacaacttagtagcaaaaaacaagtaacccaaataaaaatgagcaaaagagttgaataaacattttttcccaaagacttctttccaaagaaaatatacaaatgcaaaattatagtataaaatcaccaccaggatattgacattaatacagttaagaaagagaagtgttccatcaccactaggaaacctcatgttatccttttatagccacaccacttcctccattttctcttttttctgaaccttgtcaaccaccaatctgttctccatctctatagtattgtcatttcaagaatgttatataaattgaaccatacaatatatgacctttggctttttcacttagcataactctctagagattatattagttgttgtatatattagtatcaataggttgttcttttttgttacctaatagtactccatgagatggatgtaccatggtcatttaaacgttcatccatttaaggatatctgtaataagcctgccataatcatttgtgtacacatttatatgtaaatataatttttcattttttaggataaatgcccaggattgcaattggtgggttgtatagtggtggaatgtttatttattatttattattgttaagaaactgccaaaatgttttccagagttggacatactattttatactactatcagcaatatataaatgattgatattgtaattttgcattttagacacactagcagttatgttttgataacttaccctgattttcacttgtattattttgttagctaaccctatttgacatagattgatgtgcatacttgcatctgcaagcatccatacagtagaaaaggacaaaaaatgctttagtgttgctatgataataatactgacattgcaaatcttctgaaagtgtcttggggacaccaaaggcatccttggccatgtttgaaaactgctgaatttaaacttaatatggaaaagtgaaacatttggtgttcttggtatgattaggacttcattttaattaataattttttttatgtcagaaagtgttgtttattaaaacatagtccgaagcatacatgagttttcatgagatcagtatacgaggactcatggggtaagctcaactgtgatccacagacaataaattgtgcctttagttatcttgattgctttagggaatgcttctctaatagcttgactcttagtttatactcagaagaatcacctataattttttccattctcttaattgtgactaaaatgaaatcattcaaaggatttttattatgtacctaaaatttgccagagtctggggaaaaataaataaacaaaattggttatatatgtaggagcatgagttatggcatctaacctttaggattgtgggtatgaaaatagtttttccagagaaatgatgatactgcaaccaaatcttaaaaaacatggtgagattaagagaactgggtgtgagagtggaatggcaggctttattcctttagagtgggatttatggctcttgtgtatttatttcttagactgtacctgtatcaaaggacttaataaatgattaagtggaatggagtaaaattgagtaccagattgatgatacacataatactgtgattagaaaaaaagtgagtcaaattattaaaatggcatttaaaaatatcattgataacaacataaaatttattttcatgatttgccaggtgtgtgttcttgagatttgaagaaattagatggaatgattctttagtatatgatgccctggaaaatgaaaacatccaagtgctgtctctctgtttccccagcagtgctgtaattcaaataaatacctttctttctcctatagctttaataaaccgtttgaatgttacataaacttttaaccctttttgattaaaaatatataggtcttacaagtttaaagtgaatatcatttattctaattttataatctttatttaaatttaggaaggtaattctcagagttaagataataaagatattgctaattagctgcataatatacatttatagtcatatgtcacttaacagtggaaatactttctgaaaaatgcaacattaggcagtttcatcctgtgaacatcatagagtgtacttacataaacctagatgggatagcctacgctacacttgtgctatgtggtatggcctattgctcctacgctacaaatctgtacagcctattactgtagtgaaaactataggcaattgtaacaaaatgataagtgtttacatatataaacatagaaaaggtacagtaaaaatacaatataaaagataaaaaatggtacacccgtataggtcatttaccatgaatgaagcttgaaagattagaagttactctggtgagttggtgagtggcaagtgaatgtgaagacctaggacattactctgtactactgtggactttataaacacagtaaacttaagccatactaaatttattaagacacctttttacaataataaacttactgtaacttttttactttataaactttaagttttttattatcataataacagctttaaacacaaacatattgaagagctgtgcacaattattttctttatattccttttctatatgctttttaatatttttaaaagtttttattttttaactttttgttaaaaactgagatagaaacacacacattagcttcggtctacaaagaatcaggacctgtaaatatcactgtcttccacttttctcactgtaaaatctttaggggcaataatgtgcatgggggcattacctcctatggtaaaaatgccttattctggaatacgtcctgatagattgcctggggctgttttacaggtaacttttttcacaagcagaaggagtatattctaaaataatgataaaaagtataaagtatattatcagaagtacataaattagtaacatagtgatttattgtcattaatgagtgttaggtactgtatgtaactgtatgtgttagattttatgagatattataaaaaagacttttgtgagactggcagcacaggaggtttgtacaccagcatcaccacaaacaccagtgatgaggtgcactatgacattataataactatgacatcactaggcaatacgaatgtttcggcttcattataatcttatgggatcacctttgcatatatgatttcttgttgaccaaaacattctggcaataggtggtgcataactgtagttactatgcacatgaactctttaggtgccaattaagataaatttgagaaacaactaaggagacaatagagttttatttgtgtgtgaatgtaaagtagtaagagaattgctatgaggaagaaaaaattgtaatgatataatccaacagatttatgtcagtagtccagatttgtctgttattgttatagcatacacttaaaaaatgtgaatttgaatacctgaccaaagaaacattgaaaaaggaggctatatcatgcctgtaaagattagctaaattttgtgtttgtgtgtgtgacggagtttcgctctcgttgcccaggctggagtgcagtggcgtgatctcagctcactgcaacctccgcctcccaggttcaagcaattctccagcttcagcttcctgagtagctgagattacaggcgtgtgccatcatgcccagctaattttgtacttttagtagagacggggtttctccatgttggtcaggctggtctcaaacttctgacctcaggagatccactcgcttcggcctcccaaaatgctgggattaaaggcatgagccactgcacccggccaacttctatataagatggaaatcagtacaaatgtactgattttaacagttaaaaattaatattcctctataatttgtattttcattacatttctttcacaaaatttaattataatttaagatatacttttaaagatttattgtgtgtgtataaaacaaaaaatagataaattgtgtgtacaggtgcatgtatatatgtgtgtgtctatttccctgtattttaaaaacctgaacagtattattctcataaataatttagtattaaattgatcaaaacattataactatattacaaattaaaagaattattacagataaaataatttggcaatgacaaatttttataagatgggtggagttctttttccaaatgattcatggatccatagataattattacttcctattagaattgagacttatgtaagctaaaggtttatatatcacttatttgtattttttagattgtattataaatgtaagggctatgaaatactgttcacataaatgaacaagtaggctagaagaaattctattgcagtgacattgaatgtttttaattctttctattttccaaaaatcacatgatgaacatgagaaaataattttagtgaccagctgatcatctgttgaattttccttcaattttgatagaaacaaaaaattggaatctatttgacttgcaaaaatattggttacccaataccaacagcaggattttgaaatgtcactttgctttccctaaggttttttacatgttggagcaatacatcataataaattgaggatagaaaattcaagttatcttgcattgtaggaatacaaaagggaagaaaaaactaacatggctgatcaatattaagatacagctcaggttcaaagttaattcagcctcctagatgccaatttctcctgtaggcaatttatttgcctgatctaatttaacccttatagctgtctgtgatataaggacttattctaattcttcagatgaagaaagtgagggctatagaaggtaaccagaatttgagggcagagctgagatacgaacttcagttcaatgactcctgattctgtgttcttttcacttaaacatcaattaggtatttcaattttataatctgaaactaagaacccagttgtttatggcaaggtggggggtagagaaataattttttttgtgtatactatttctgactaataaatgtctaaatcagccagaacgaatgactgtctctccttgactcatagtttggagagcaatcctttggtaatccattccaatgttttgtctgtaaatagcataaagatcacaattaactagattaagcttccatgtgaaatttttgccatttaaaaatttaactttatactgattcattattattattttaatctggacagttttgagtctaggtttggaagtcacagacttgtacatattgatgtttcattgaatatatgtaacactagataaattacctaatgtctctgagcttcagtttcctcatgtttaatatttgggtaaaaaggttcatataatgtttgaatgcagtggcctatctaaaatattaacaaagtgtatggcatagaacaaacacgtgcatatattgatgaagccaaatgaaagaaagcattgatgaaatgaggttgaagaggcagagatcacagagtaccttgtatgcctagattaacatctttatctttgagaagagaatataggcaaaaaatagttcctaaccatagatttttttaaaaaactcattttttttttctgattagggactattttagttttaagaaaagttgtagaaatagtacagataatttctatatatccttacctcagttttccttaatgatattttacatcaccatttgtccaaacaattggtatgatactattaactgaactactacaggtcaggttatatccttttatttttatttatttattttttttgagacagagtctcactgtgttgcccaggctggagtgcagtggtgagatttcggctcactgcaagctctgcctcccgggttcatgccattctcctgcatcagcctcccaagtagctgggactacaggcacctgccaccacgcccgactaactttttgtgttttttagtagagacgggggctcaccatgttagccaggatggtctagatctcctgacctggtgatccacccacctctgcctcccaaagtgttgggattacagttgtgagccaccgcacccggccaggttatatcatttttataatggaaaaactactagaaaaaataagaacacttttatttaattaaactaactttttaggagtgcatttcttagctctttcttagattttagatatttcaccaacatgaggtagtgattaggttgaggacatcaatagttctctctcctgcttaatgttcagaaaccacattcacttaggactctcttaatttcattaacaaacattgcctagatataatttattttttgttaactactcagaacacatttaccaaaatttgaatgcttatttttagccattttaattgagtaggtaatagagatattgtatttctgattaatatttccaaaattttcagctgtgttttttcaattataaaactaggaggcaattctaaaaatatgcactgaagaattagtctgtggatagaagtctgcaaaatccaacctccgcacactaagactctatttatctcccaatgatcatatcttcagaatctcccacatttctttacctccaacatttaaaattgtatagtcctttattgggtaaatagcccatgcaataaaatgccttagatttccaagctttttgccctggttaggccaatgtgaggtcttcaataagaatctgggaattagaaagaccgtgactcaacagcaacagtgtttaaaaaaaaaatgttaatgtctgtctcacatgtctgctcagttactcattgatttcggctcaagcccctattaggaagtgattttttttttccacaaagaaaggagtataaagtactcctctctctactgcagcacaggagagccacagacaggaattcacagaagcatcagacctaagcacagagaaagtcagaaccagaatattaaacagatgaggcaaaagacaactttgggcaaagctgaaggcttttctacaaatagtaagatgggccctgaaaaaaagcaaatggcatggtatactcacaaaacagatcagcaataatcagacatctctaaagagtcttgacacaaataagatagtctcctagaaaggattaatatttttgtaatacctgtaacgtaatgacttggaaatttatgtcagactcacagaacatttgtcacttgatatatgtattaatatgtaagttagagaataaatgtgcattttcttattccaggaaatatttggttccagtgtttcaaaaaatcattttgtttacattttggaatcaaaagttcaataaaccctcccggcgttatgaaatcatgatagtgagactagttagaccctccatgacttgagaggctactgttgttttaaaagactggtttttctcaggataaactaattactcatcacaggagaattccaaggccccaattctcctttcacctgcctgtgactttcccattattcattaggtttagattatttaagagttaatagcagcatcaggaatgaaactgcattgctgaacaagaagatgaaaaattatggctctttgtgaaatgaatttttcttaaaactaggtctgttttaaagacggtaggaggtgtatgaaggattttgatacactctatagtatttatgtcttttctcacacagtaaagagtgcaatcttaaagaaatacaaattgaagttaggaatcctgcgttcaatctcggctcttccactcactgaatgtgtgtctttgacaagttccctactctgagcatcagttacctcattagcaaaatggagataatagatacctaatagagaatgggaggattctatgacgtaacagaaagctttttctatggttactggcacatgcaaggtgctcaaaatattagctgcttttttttttctctccaacatcaacattttatattttcaacatttttaaaatttaatttcttgacatacaaaatactgtacatcaagcttgtccaacccttatccttgtaagccacatgcgactgcagcccaggatggctttaaatgctccccaacacaaattcataaactttcttaagacattatgaggtttttttttttttttttttaagctcatctgctgttgttaatgttactgtatttgatgtgtggtccaagacaattcttcttccagtgtggcccagggaagccaaaagagtagacacccctgctgtacataattaatggatacaacttgatgagtttggaggtaaatatacacccatgaaaccatcagcacaaccaatgccataaatatatccatcatttgcaaaagtttcttccagctttcttgtttattattattactttttgtgacagaacaattaacataagatctaccctctttgcaagtgtttaaatgtacaatacaacattaactacaggcactatatttgtacagtaaatacctaggacttatttatcttgtattttagagcaggctaattgtgaggaaggttggcttcaagtggagcagaaactgatctactacaaatgaaaatgcgcagttttctatatgatacccaataaagtagatgatatacttaaggatgtataagcagaaatgctgaatgaaagggtaataaaacaattttgtgcaagattactatgagtttgtatgtgttgacaagggaggtgtgttgatgtgcaagagaaagtaattgttctctctacctatatttaccagggcattgtgatgccaaataacattcatgtcaattgtcataagcagcacagaattttgaggtaattctatgcatgttgcatctgtctttccctctatagcaagtggcttctccttgaatatccagggcaacaaaatatgaaatcttgaattaaaatcttaatctttcacttgcagaaatgtgcttcttacctgctgtggtcacttattttgagctagtctcaaattcttgtatatgacaccacttcaaatatttaagaccttcatagctgatagcaagtagataatactttggaaatttaaatttctgcgttccgaatggaactttatttttgttaatgaactcagttttttaaagactttggctcacgcctgtaatcccagcactttgggaggccgaggtgggcggatcacaaggtcaggagatcgagaccatcctggctagcactgtgaaaccccgtctctactaaaaatacaaaaattagctgggtgtggtggcgggcgcctgtggtcccagctgctcaggaggctgaagcaggagaatggagtgaacttgggaatcggagcttgcagtgagctgagatcgtgccactgcagtccagcctgggtgacagagcgagactccatctcaaaaaaataaaataaaataaaataatataatataaaataaaaatagaaacaaaaatattttatgttaaatcacctgggatgaatttctcaaattcatttaaaaatgttccttcattttgacaaagacttgttttaatctcttcaaatgaatctattatttgagaataaaatcttgctagactctaaatctccccacatgagaaatagagttttatatgatctattagaaaattaaactgagagtttctccctcaatattgactagtttactagggatgacattattcattttttctctttccaacagtattatttaaggggaatatgctaagtatacaggaaaaaatagcatatctaagtattttttttttgtatttatagaaaagagttggaggaagttaagtcttcactagcagcataaaagaacttccatttttatctctgaaaaaacaatttgtgtgtgtgtcagatttactgcttaattgcaactaccacaatataaaaacttactctggatgctcaattcagcaaacaattattgagtgttgcttctgtatataatagagtgctactaatcctaaagaatacagtgttgaaaaactcagcatcatcaacctcctcctcaaatctattatgggtaaaatttacataataacagcaattattaattcatttttttttttgccaagccctgtgttcagcacttggatttttaaattttcttacaacaaccccatgtattagatatattatatctatttattggataaagaaacaaaacctttggaagataagattcaggctaccatagttctatttgagaaataaaaaaagtgacattgaagaaaggagaggaaatggtagattcgcaagattcacgagaccgaagtacactccagccaggtctcaatttttgttttaattactgtcacaaccacaatccgattctctccaacttggtcacaattttatatcagtttttaaatattcattatatttaatcagtcagtatctgcacacactctatgtattttaagttgtaattacctaggaatcaattttattttcctcttcttgaggttaaaatcaataatcattaactggaatcatttcacttaaagcatcattaaatttatcaaattaactaatcaaataggtggaaccaacataacaaataagcaatttcacaagcagccatgtgctagctgcaacctgaatattcatgtgaaagtgtaaaaccaacgtgagaccatagctctctgttcaaatggaagctaggcacattatattcataacattatttcattcttgttataaccaagggaggacactattatgatctccattttatacatggggaaactaaggttagtggaggcacaattgacttaccaatgtttggcttcaaagcctaattttttacctcatagtatgttggaatcaaaatgagaccaacattgtcattttaacagaaatgaaacaacatgttatataatacatttagatggcagtgcttcacaaacattcatgcccatatgagtcaactggggataatgttaaaaggcagtttctgagtcagtagatctgggttggagcctaggattttacatttccatcaagctcccaggtgatgccaatgtttctggcccatgggccacactgtgagtaagaaggtttaatttagagctttgagatataatgaagggtggtcctaggtgggaggcatcagcatgatgtgagagtttgttagaaattcaaactccctggcatcctttcaaaccccttgaattagaatatctggaaataggacctgaaaatctgtgttttaacaagacttcaagataatttttgttcacactacagtttgagaagcattaatgtaaattgcatattgaatttgtatcagaaaaagaaatgatgtcttctcactcccttcctctataccagattgtttctcccagtgctggaattggctgccatcacggtttgtgaaacgtcaagattttattcatagtcctctttctttatactttatatgatatatttgagaaattttatctattcacaagctttaactagcacctacctgcagaagaataccaaacttatatctcttgttctaacttctcttaatttaagtcctaaacgtctaattctcaaatacatatttatctgcacaagtatgtcccattgacacatcagactccttatgtctaaaacagcactcatcagttttacatgataagtcttctcaattatctttctgtgtttgatattcccatccactgcaattatctaagacaaggtcttcagaatattgattgactacttcttatgaatcacttcttacacctaattatttaccaagttttgtctttcctatttttctttctagtatgttcctacttacttacctcatttaatggggtgagagagaagacattaaagagatgagagataagagatttttgtaacaattcatgctaaaagttgatacggttttaatgtaataccataaaattgggcacacaaaagaaaatctaagacaaaaaatcatgatagaatgtaaaacttacaaactgaaacacaaatgatggcctagggtgttaaggtattctgaaatgattctatattggggactatgctctaataaagctgacatttattcacatggctaatataaacttggaatataagattctttaattcatccatttatgattcattcatacatacaccaattaatattataagcatttattgaacatatatttaaagcattgtgctaggctctctaaatacagattatctatctatctatctatctatctatctatctatctatctatctatctatctatctctattgccagggagataacactgtttgttagccaactcaacagatgtttttcaatctttttctccattttcatatctactccagaagctgggaaggcaaatgcccaccttcacagcttccctcacagttgggtatagttctggctaccaagatttaaacaaatattttctggagatacctaaaacaacatctgctttcttgataaaaaagacacaggttcaactggcatgaacctttatcatctttctctattctctttctgatcttgaaaacaaatatgatatctgtagatactatagccactttagaactaggaaataaatagctttaggataaaggccaacattttgagaggataaaatagtagaatattgaatgtctgaatccctctagaaagtgttgatcttcctcccatttcatgttatccaggcaatagcttttaacctttacttaatcttctaatttttaaattcttaaaagcattattcggtaatttaaaatttacatagaaattgaaaaaatatagggacctgttgtataactttcacccagatttccttgttaacatttctcttgtttcaaaaatgttaagagtaagtttcagttatgataccccattactccttgtattagtttcctgtggctgcattaacaaattacaacaaacttggtggatttaaacaacagaaatttattctttcatggttctggagaccagaaatccaaaattagcctcattggattgaaatcagggtattggcaggatgggggtctcctccagagagagatctgttccttgcttctttcaactaatgttggttatcaatgtttcttggcttgcctccatattaacccaatttctgcctccatcttaacactttcttttcctcttctgtctggattaagtatcgccttgcctctctctgataagagcacttgtggtggtattttagggcccacctgaacaatccaagataatctcccagtctcaaaatcattaacttactcacatctgcaaagaaccttatttgttatatgacaacacttaaacaggtgtaggttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatacatgctgattttgtttcattattgatgatggtaacatttattatttaattaatggtgcctgtgagatttctacactagaaagttaataagtatgttatcaataaataatcattatgcattgatggaaagttactttgagactatgtgaatactccatttttcatcagtcttttacacaccagatttggcattcattgatgaattctgcctgaatgagttttcactgatgattatcaagtggtaatctcctaattccataattctttgtagattaattagttggcctggaagaattcccttccaattccagcaccacccccaatttatatatgtatccatttatgttagtaaaatctcataaattcttattttactcaaaatattataactggtcattattattgttaagagttaaagagaaaagaaacacaaaaagtggctcaacagtcaaagacaggtttattttggagaataaacctgagaggggcttctggccaatttcagtcaggagtgctctctcttatagactaagagtatgtattggttttagggtgagggaacttattacagacttgaaatgtttctgtgtgggggagaagttttatgtcagggttggaatgtctctggttggaagggaggttatctcagggctggcatgtctctggttggggagaggtttatattacggttcgaatgtttctggtcggagatgtcatttatggtttatggtcatgctaaccttagccattaggctgatgccctttggatttaggcagtttttgatcaaggggaactttaagatggcagtgcttgtccaagatggcgatgctcctgccgtgtcaattatcacttatttgaatttgtcccagacttgactagtggaagctccttcaactggttcttatgtcttttgcacatgcccctagagtacctctggcacaacaggatgttaccagatcatcttgtattttccctgcctcagccctggagtcaggtactcttccccaggaagctctggctccctagtatctagaaacaaataataggacactatatgtgctcctcataactgcggtgtaattacatgtatgtcctctaaagagagtcagataaaaaaaatctatttatgcactattcacagtgaaaaagatatggaatcaacctaaatgcccattaacaataaactggattttaaaaaaagtggtacatatgcaccatggaatactatgcaaccataaaatataaaatgatcgtgcccttcacagcaacatgggtggaactggatgccattatcctaagtggactaacacaggaatagaaaactaaatgccacatgttctcacttataagtgggggctaaatattaagtacatatggatgcaaagaaggggaaaaaagtcactggggcctacttgagagtggagagtgggaggagggtgaagatcaaaaaactattagcttctatgctcatcatctgagcgatgaaataatctgtacaccaaactcccacagcacacaatttacctatatgtcaaacccgcacatgtgccggtgaacctaaaataaaagttaaaaacagttaaatttaaaaaagcaaatctatgtatacaaataatatgcacatatgtgtatatctatatgtttttatattttaattttaactggagctctatcatatttgatcattgtgcacactggtgcttctacttgcattccaaaactatctcctttccatattcataagtcccattttcaacaatgagaaatatgttttccactaccctaaatgaatttcctaatttattcagtcctgccgttgttaacaaactcctcaccatgacagcagaaagcagtgtccttgactcacatccatattgggtgtactggctaaaagctcacacaaaggaaggggagaagtagggaaaggaagaaggtaaaagagggcagaaagaagggtgaagaaaaggacatttagaaagcacaaccccaaaatttcatttccctgtattaatatgctggctcatagctgggcccctacataccactgcccactgcccacttcccactgcctacatattgtgtacaacacctgaaagctgaactttcaaaaagggaaagagaaaaaggaagacaaatttatcagttagaactgttgattccagatatgtgacactcatcataccaatgcgttggcccaaagtgggccctgacatgctgttctctgtccccactgggcatgcctacccaaagcttgactaatgtagtagtttaattactttcagtttaatgttgctgctagctgtccaagataaatcaatgtttcttcttcctatgtacagagtaaggctccatttcagcttcctttttagctacttgaggccaaatgatgatgttttaaccactggaatgcaagtagaagtgatatgtgccatttccagacaaagacgtttaagaagaagctatatctccttcactacctcttcactcttgcctgatggatgcagatttcagtgaaaatctaggggaagcaggggccataggatggaagaagcagagcttcgtaagttatgctatgtgaagcagagccacccacgttgaactattaggtaggtgagaaaaaagcatccatttatcttgaagccactatacctcctatgatctatttgttacagaagcttattcaagttacacaaacacacacaacatcttaaactaatattatctttataatattatacctgttgaatagttatgcatagtatattatatgtacactgaataaggtcacttaatacatgttagatacggaagaaaatcaagaaacgtttcccacaggaggtaatacctacttgagtattggaaaaaataagtattaattaaagaagcaggaaataagattatgttcccattagagataacatcatgtataaaagtacggcaaatgaggcagtggatattgtgtttaagggaagtcaagtttcttgatatgactataactcaaaatgtatgaagacagtcatggaaatataaagctatatatgtcatgctgaatttctttctgtgcacgaaatttagcattttaatggaaaatgcaaagtatatacatattctttctttttgacatcagtttatttcttccctgttaatgatggtctcatgtctaaagcaaaagatgtaaaataatcatacagaattcttactgctataaacatctgatccttgatggagctattaacatgaagccatgttaataaacattaacacctttatatcacatatttgataaagttaaaagtaatttcagctcatttgctatactctattttgttagtacccaggagcattttcttaataggagttccaagagatcactgattggtttcagtaaagaaatcactgacataaagatgttcttttgatggggaaattagatttgatgcattccgcaagaagcagttagatcttaatttagagggtaatttggtacctaaaactacctgcagaaggtttagtttggggtataaaaatactgtccccaagcattgggtagtgtttctcacatgcttggatacttgcatcttatttttccagcaagtaaatatatacatatatatataatcagtgacagaaaaaatatgaaaattttttaaagcataggtgttttaggtcatctcttagaatgcacaattgatgggaacaaaagttaaatgactgaaatgcattcttatattatccacttagttttctcctcacctgttgttcattacttccattctgtattcattgctattgctcttgttcaggcccttatttcctcctgtctatgctaaataattgtcgtactttcaggattgtcctttgctgtctataatacaccttccacactgatgctgaagttttcttttaaaaaatctaatcttattgttactacatctaaaaaacccgatcctggctatccacagccaagagaaataattaaagatttcttgtcatatcatctaaaccctttgattatctgactcttacatacttattttttagtttggtttttattttttaagtatacaattcagtggctttttagggtattttcaaagtttgaaattacttatactgtctaatattagaacattgttatcaccctaaaaaaatcttgaacactttgtgttattttttattttttagagacagggacttactctgtctcccaggctgcagtacagtggtacatttatggttcactgcagccccaaactcctggcctcaagcgatcttcctaagtagctgggactacaggtgcaagtcaccacacccagctaagttttttatttttatttttggtagagatgaagtctctctttgtttcccaggctggtctcaagcttccagcttcaagtaatcctcctaagttggcctcccaaacagtcgggattacaagcatgaaccaccatgctcagtccttgaaccctttagcagtaactacccctagttcctggaaaccactattctactttctgtctctctagatttgcctattctgtacatttcacgtaaatgaaattatacaatatattcctgcctgtttaagccttctctcttttgtaactccatctttcatattcttccagctgaccagatctaattgtaacatactgtattaattttaattaagatacagattgactactgtattggacattcaaaattaacaatgattttaatatgacatgtatttctttttgtataagcctgaattgggctttttcacataaaattcttcattaaatttttagcagtcctaaatctctcaattctgttgctccactatcaatagacatcacatccaaattcgaattcaaaggaaggggaaggcctaaacatgactcacctgtaaatttgatggtcactctatttttgctcttaggtgtagtcttcactttttccttttctgttgtatcatccaatggatgaccttggtaggttaggtatttccttcctcttggtctgtcttgggtgcatcttccatagaagctgccttttctctgtgcctctagcctcagacaaatggcccatactctcatcactcaattctcaacatgcatccatcagcagggagctttagcttttggactcatcatattatctgttgctatgacttgaatatgccctctgaaactcatgttgaaatttaatccctaaagagtgttgataggtaggacctttaaaagattattagaacactaggactttgccctcatgaatggattaatgccgttattgcaggagtagtgtccttataaagaattagctgagcccctttattgcttgctctctcatgcatgcactcttgaatttcagctgtaggattacatggcaagaacgacttgctagatgtaggccccatagcttcagacttcccaggtgccaaaagtataagaaataaatttctgttcattataatttatccgtggttttctgttacagcaacatacaatggactgagatatccctctatccctataagtggtaggggcatcattttgtttttaatctttaatagatgaaatactcttcagaagtttatatatatatatatatatatatatatgtgtatatatatatatacatacacacacatatatacacacacacacacacacatatatcttctttagtgagtttggtaaattgtggctattaaggaattcattatgcttggcttcttggattgtctgtcactgtgtaaaaatgtcttctataaaatatcatctgattgaaacacttagattggtctcaaattttattagatgtactatgcccgatagggtgtatgacattgaattccacacatacattttgcatttctcttggcctagctgcatggccacagctagctttgaaagatggtggaaaatgcagtctttattccggagggccatacacactgctaaagattatgcttcatgtttattccatgagaggagaaaacacttgatattaaaggaaaaccagaattatctgccatagtatgcgccttggtcagccaatcatttgtgtacacttccttccacatagagaacgtattcatctcatacccaggggggagacttcaaagtctcattcatgaaagtccattgaagtccatgaacttgaggttatgagtactcacctttattaggtctatctatggttcttcatgatccagtggcctataacatacccaaaacgcaacagtagagtaggaacagtataaccacactaaaatgtccatctgacttgtcaaatttgtggatatagagttgctcacaattttcccttgttatttttgtgtctgtgaaggtatgtaatgatgtcccttattcaattcctgatattggtatttatgtcttttctcatttttggttgccagtatgactagagttttattttttccaaaaacacagcttttttttaaactgcttttctgtttttaatttcattgatttatgctcctagtttttcgatttgcttgctttgagtttgtctcttcattctctaatttgttaagctagaacttgagtattgatttaaggtctttattctttcataagcatttaatgctatagcattctctctaaatatttatttagctgtgtcttacaaattttgatgtcttatttccattttcattcagttcaatatttttaccttgagacttctttgacctctgtgttacttagaaatgtgttgtttaatttccaagtacttaaaggtttcccagatatatttctattatttctttctatttaaattatgttacggtctaatatactttgtatgatttttactttcgtaaatttaaagtctgttgaatttcctattctgtgttctgtcatgatgaaagtttcatgtatgcttgagggaacaatgcatattctgctgttcttcagtaaactattgcataaaatgtcacttagatcaagtagtagctaatatttttgaagacttctgtaagcttcctcactttttgtctccttgttctgtgaattactgaggagtgttgatgcctccaaatccactacaattgtgtgtttgtatatgtctcctttatgtaccaacagattttatgtatttacatatgttgctggctacataccaaattaagattttaaaaataccttcttagagaaatgacctgattgtgtacctttttactcctgatgatatatacctggttctgaattctaccttgtctgttattaatattgctactccagctttcctttgtttggtttgtgtgtttgtcaaatctctttccatccttttacttttatcatacataaggctatatatttaatgtagtacaatggactgaatgtttatgtcaacccaaattaatatgttgaaatcctaatctcaatgtaatggtatttggaggtagggtttttagaaggaaattaggtcatgagcatggagttcatgacctaattcatgaatggaattagtgcccttagaagaaaaggccagagagtgagctagccctctttcctccatgtgaggatagaatgggaagtctgcaaccttgcaagaggcctctcaccagaaatcaacacactggcaaactgatcttatacttccagcctccagaactgtgaaaaataaatttctaaagtttataagccaccctgtctaaggtatttgtaaaagcagcctgaactgaataaaacaagtacgtttcttgtagatagaatataactatatgccttagatttttattcagtctaacaattttgtaattggtgtgtttataacacctatagaaaatgctattattgatgtagttggattataatatacagatctgctaggtatattgtatttgttcaatatgttgttttattgttctttttctgaccacttgagttaacttagcaactttttaatgcaattttcacagtttttctttcagcactttaaagatgtcattctattatctttcaatttgcacagtttctgagaagtcttaaataattcgatataattcttttttaatatacaaaagtaggccaagtctattgctgagaatggatataattcctattcttatttcactgtgtataatttgacctcattctttggctatcttgaagaacttctctctgtctttggttctcagtagcttgaatatgatgtgccaagttacagcacttttgatatgtattgtgctttttgttctcaacttcttggatacatgctttgttgtcagtcaataattttggaaaattactatgtttcacttctccctgcaggtgtctgtctatttgtttattggtggacagttggctgtcctgtgaccacagcactcagatgggctcaataaaatttgtgaacttgctgtttgcctggctttttaaaaatgtgcatgttctagttctcaaaactactgagcaaaatatagaatttaaaatagttttaagtctggagagtctagtctttaaaaaaaaaaccctctgtgccctgcctattctactgttactctcagaaaaataaaatgaaggctatcttttgagtcatctaaaataatatgtttggatgggaaggtaacatccttaattcgatttttgctattgtggtggctccaatgtctcactaacaatttttaattaaaaacacttggtgccatattctattctccaggtaaagtactttttcagggctgcctactattatttttcaacctaagttacaaaatcaattcactttttgaatatataaggccccaaattataaaattttcagtcaacctagattacaaattgcacataaagagtgtgtccctgcactgatctgtagagtctccaatctgtgtaaactaaatctccatcctagtgtccttcatctcttgtgggcctttactaaaacataaaataagaataagaatatttctaaacctttcctcttgagcatagactctcacaggaaggagttttctttccaagtattaggacaagttttaccaaatattggccataatgtactgagagttttcagctttccaagatgtgatatctgtatcttcacagcctctcttactgtctcaaagagaatgccatgtattttatattcgtttcgtgaaacagtccattgtatagaataaagggtcacataccataaaacatccaaattaagaaattacaagtggtttaaacaagataaaaaaagtaaaagccaaagctagaagaggttgaccggcacaatgtcatggggtctagaatttttccatcctataattctgccacctctaccaggttgctttatctacatggtccaacatggctaaatagcataactgtatttcagccagaaggaagataaaagggatgtcaagtttattacttcttctccttttgaaacataacacagatgttgcaaacactacttctgctcacattcagtgatcaaaactaacataaatggcaatacctaactaactgtatggttagtgaggctgaaaaagtaaatttgattctgggcaactattttgcctagcttttaattcgtaattttattactattagaaaggcataataaatattggggaatgaccaacagtatgccacatatatcctgttatttaatgtaaatttgcatctgctttaccatttcccattgtctgaaatgtttcctttgttttccaacttgtaaacctctctgtttcttttaagcctgcatttgtatatcacctcctttggtaagttttttttgtttgtttgttttttgtttgttttgagacagagccttgttctgtcaccaggctggagtgtgcagtggcatgatctcagctcactgcaacttctgcctcctgggttcaaacaattctcctgcctcagcctcctgagtagttgggactacaggcgtgtgccgccatgcctggctaatttttgtatttttagtagagacgaggtttcaccatgttggccaggatggtgtctatctcttgacctcgtgatctgccagccttggcctcccaaagtgctgggatttcaggcgtgaactaccgtgctgggatggtaagtttttattgaactgcttctctccacacaacaaagatattttctcctttgcctcacattatttttttctagattatttgaatcagactgtaagatactgtaggttagagtacgtcttactcattttagtgttccttgtatctagtaagggtttgctacaaagaagatacttaataatggtaataaatgcatatattttaataaacagttgaataggtgatagaattaatggatagatgtcaggaattattaaattaataaatgaatgaatcagtgactaaatgaataaatcaacagattggtaatggtttcaatatacagatatgttagggaataaatggatgagttagaaaataattggatgagtagatatatgaatgaattatttagtgtatgagtgaatggttagttgaatgcatgaagagagtggtggaatggatgacaaggtaagtgaacggaagaattgaagaatggctacgtgaatataagaacaaatgagtgtgtggatggaagagtggatatttggaggaaaggtgggtggatggctaaattattaaactgatggataaactgatgcataagtgtattggtgagtgcatggcgaatggatcctacatacatatataactgaaatgacacttctgccattctgcactgatttgagagttagaacagtgtggatttttatcatacctctgccactgactttctgatttttatgcactacttatgcatctcagtttatctatgcatctcagtttccttgattctaaattcatattataataaatgccttgcaagtttttgtggggataaaataagacattatataatgtgactggcacaaagtatgtgctccataaacagtaactgctattacagtcatcattaccatcatcgaattctcagccagttctaatttcctgcacagcatttcactgatcaccgggtgtacatggaaatatatatgtaatcttggttctgccttctaggatctcctagtaactctgggtagacaggccacatgcataaaaggattatcaccattaaaatgaagggaatgctcaatgccagatgacaaatttatgataaaattgaaaaagaagaggatcatgaatagtcaagtaagtcttggaatgttatgttgaagtttgggaagtaaagaaaggaagaatttaattagcagagagaaggtgataatatcttgcccatacttctcattaaattgcaaattatctgaaggatctcaaaggaaaaatggataagtagcaagagttccatttatctgtgagacaaatgaggtctcaaaacatttgaatgaatggcccaaggacagacagtgactttgaccctggcacagttgcaaatggcagcctcagttcttggctgctgtgtctctttgggttcgccagtgtttttaaaacaagcaaaaaaaaaaaaatgctgtaacatttttactgaggacaacttggctgagttattttgacaaaacacaaatcaccgggaacagctgagctgcttgtacattgcacccatttgtttacccacctgtctagatgctaagaacaatattctaaaacagtgagttcatatatggtgcctacttttggtgttctccttttaccccacttggatccagttaaacctccttgaattatttaggctattcttgaagaatttctcacctagagattcacaggacccctagcaactataaattaaagagccagtgatataatctagcagttattttaggccccaaagttgaacaccattggattgaaatccagactctaccagttattagctatgtgttcttcagtatacatgcttctttctgaacttgttttcttatcaatatcatgggagtgctaatatctgttaaaaaccgcttcatctagaatattttttatatataatataatcagaaataatggttgacttcacctgaattcatttttggcttactgtttatactaaggaaaatatcttacggtcatttggtttcagatctgtgatgttattttagtggtctcctttacttccatttctgtcaactgcaactaactctactaggtcaccagcagtgatggggaatctaggataaatcagctcaaacatgttcatctcacacatttttccaagtttcctaaaatttctgggtattgtaagcttcccaactcatcttcctgcttccacacttgccctactactatctattcttaagactatctaatgtgattcttttaaatcagatattaggtctgttgcaccaagcattaaccagcactcactcaactttagttagcaatggatgttccttcctaggaaatatttgtctttgcccaaaggtggtttagaaagtcaatctgaagaatttcacaaagcccttttaatatttagcaatatcctttatgtgcctacttcatagttttttttttgtgaggatgacacaagcttatataaagtacttagaatagagcctgacacacagtaattgtaatatgtgttaattattggataatgtctctgttctttttacagccttccagtcattcccaaattcattcattctaaatataaatagacctacataatcagttccctactacttctctgactgcatgcctttcacttgccccattcatccatcttactctggccaaatggtctccttgctctttctcaaacattctaagcacaagtctgcctcagatcctttccaagtgcagtttcctccgctgagaacatgctttacccggagtctgcatggcttgcttcctcccttcatccagatgtctactcaaatgtcatcttatcagcgatgactttgctaaacaccatatgttaaactgagtttaaaatgttctatggaaaacaagaaaagaaaatctttccgaagtctagctgtatatatactttcttctgtcaagaagactttgtttgccttcatgatttattccatctcatctaaacatagataggagtgtgatttttagcaatacactgacctcttatcacatttccctcttcctggctaggcagtggttctaacccagagctctgtgtctctggctgactcaactaaggtcaatatctgaacattctctcaaataagaggtgaaactgttatgtggagcagggaaggaagggtgttagtagtctcttatttgttcttgaaatagagtatctcaaaactgctttaaaaagagctataactgtcagatgattagtatatttttatcaatttatacctgtagaactatgtttactttagaatttgacattttaaaatctaaaatgcagataaaaataaagttatttagaaactttacatatattaatgtatataaaattaattataatatgtttatattttatgttcagcatctgaacattaaaaatgacaaaatctggattattagttaaaatttgcataatattaatttcttagacatatctgtctctgatggagccactggtatttttatgaatatatttatttcaacatgacatcacagtttttattttttctataaatttgctacaatcatcttaacatttgtattttcagttactaaaatttaaattgtttacacttccaattgacattttcctgaagagcagaaattactaatatgtgatccaaagacacctggagattcagaatcctttcacaggtcctgtgaggtcaaaactatttttatatagtattaaaatgccatatatctctatttctcattctcttatgaatatatgatcgaattttctgtaggctttctgacacatggtatcacagcattttaaatgcgatagctataaaaatccaactatcttctatgaagtctgacactttgcaaactttttaaaaataaagtaagaaaaaatgccacccttcacactaaaaatgccacccttcacactaaaaatatttctatattttctatggaaatatacaattttcaataaaaatatttgcgttaacatgtaataggttatttaagatcaatgaatatttaaatttgtgttttagtttttaatatagtaaataccagtggatattgcccacataaacaaaagtcatttggagcattcagtacttcttaggagtgcaaaggtgttatgaaacttagaaagtttgagaattgctattgtaaactataatggtttatcttaaaataccttcactgcaaatactgatttatctaataggtatcagaacaatttatgctaaatgaaagatgtctttagttatattttatattgaaatgtgtgaatatttaagcctaagccttagaggaacaatcatttttattctctttagaatattttctttggcagatattttataagacaaaatttattgaacaagttgtttttgtaattcttttaatttttttatgtttcaaaaaattgattttatgtaatttttatattatattttcagggtatttaaaagcagaaaatgataattatgatttatttatctgagaggtgaacagggtactatattatgtgcagtaaaaagaaaaattcatatacattatatatatatatataaaatatttttgaaagtgataaacatttattctgtggttttcacagcatcaggaagggagggggaaaactggagaggacctgtgtgggtgctgtagggactcctgaaggcttctttctggtggctggagggcataggttggggaagtagttgagttaaagtgttgtcctggaagttaattattttgataattttaggtgttgaaaaattctataccttgtcaacttcaatctttggtagtataaaaaatataagtttctaaaattaaaaatagttcttaaaaagattctacaatttgagataggataaaacacaattagaatttaaaaattagaacactatgcacagttagagatttctaatcttccctttctgcttttgtgggataaatttggatactttttttgtaaactctatttaaattttaaaatgaatgaaatattaagattatttaaagtaaaaataaaaaatattgtctctatgggggaagatcattttaaagcatgaactaatcctgcaatattcttcaatctaatagagagaaattatcttcattctttctgatatgatcctgttagttttccagcaataaatgaaatatatttatatgtccattttcattatagtaagttggtgaaaaaacaggaacatactttcttctgtgattttatagtgatgtctcaatctccattaccaatcattacaccatttcaagacaacctcatttttttcttatcttcatccccgttgtttagaactaagttcaagatcttgtcatctatgtcctggaactgttgagataaacttacagcttgttttctcacttaatgcttcagcactctaaagtgtatttcatcccacattgcttttggtaaaatggaaatacatccacagtgctcctcttctgaatgtttatgagatctctttgtcatgttctttagtctcttctccatccgccttctgctttagccatactgtgctgcttacaattctcttgaatatattcttctgaggatgtgttttttcatcggaagcatccattcctttcttagtgatgtcacctggaaaattcctactcatcgttcaagtctttcaacaatcctcctctgagaaggcttctccaacttacgttgacagaatgaggtcccatcctttcacatttgcatagtatattctattttccttgttcatagcacttttcaccttgaactgcaattattattactgataattactgagcatttattaaattacaaacaatggactaaatacttcatgtatttgcatacattaccttcctaagttctcacaataacccagtaaggtatgtaattttagtgtctccattttacagatgaagaaataggctcagattagttgatcaagctgagaacaaaatagaagttattgtaccgacgcttttctttttctttttttcttttgacggagtctcattctttcgcccaggccggactgcagtggcgcaatctcggctcactgcaagttccgccttccgggttcacgcctttctcctgcctcagcctctcgaggagctgggactacaggcccccgccaccgcgcccggctaattttttgtatttttagtagagacggggtttcaccgtgttagccaggatggtctcgatttcctgacctcgtgatctgcccgcctcggccgccgaaagtgctgggtttacaggcgtgagccaccgcgcccgcccagtttttctttttaatatactacatactgtgcctttcctaggagactatgaattcttgagaataggaacaatgtaatatttgtattcaatctctagcctagcagagtgcctagcgtatgatgtatgcttaataaatatttcttgaataagtgaataaaatacttgcaacaaaataattcacttaattagaatcagtgtaccatgataaatatcgtctatcactaagattttaatgttattctctgactgctctactttggaattttgttaagggatttgcattctgaacactttagcttttacgtgcaaagagtgtgaaggcagagtgttaggtgattatttattccgacaaaattttcaagctgaggggattctgtgccaatctgctactctaagctttgcactttcagattctcacttgtgaatagtatcaggaatgcctgaatagaggtttgagtttctgatgctgttttgtgaagctgatctgacgttagcaagacaaaatacaaatgctgtttcacaattgaatttttaaaaaaataatttgtaaccagcattatttaagaacctatcttataggaactttaaagagattcaaatggtcttcaactcatggtacattcagactactaactaataacaaggctttcagataaatatctattgtgcaaagtgtgagatcaagatcagaattgctaagaaaatactgaacaaggagtgatgaattctgatgagagaaaagactttctgtagtgggaggcatttgatctagatgctgaaaaatgttaaggtttagtaggtggacaagtgggaagagcactctgaatgaacagaactccacacacaatggaaaagaagcaagaaagttcaggatacatttgggacaaggacggaacaaggtatgatcagagtgtagatgaaatgtgaagaaattagatagaaaaaaagcattttaagctaacgaagaagttgagagtggagaaataaatatggcaaattattttctgtatgctgtggaaatgtacattttttgttaattttataattacatgagttttattatgtgtgccttcatcaagagttaacatacatggtttgcaaaatttaccaattttcaagaggttatagtaaggcatacgtaatcatcattaactgttaccattgaacctgaataatcaccataagatcttttagtgtcattgtttatacacattagtgattaatgtatgactctaaaacataagctgaactgtttgaaatattttatgtagtagattgaaaagaattgtcccagctctttttattcttgaagaatgataacagtaaactccttctggttctgtaactgaacaagttactcaccttatctttgcttttgattgtgtgtgtatacaaacaacacaaaattacttgcttgttggctttgtgttaccactattaatgccaatgggggaaaaaaaacacgtgaaagcgttggacaggccataaatcattatagaaattgtccatatcatttttcaggaacttagtaaatgggaaagtatccccatgtattttattattttggaaagataaatctaaaagtcttttacattcagtcttttaaattttaatccttagcccttgccattgaagcctttctacattcacccatccgagcacctgttccacaatgtaccatgcctaccaccaggctttaaggttagaacaattaacagcaagcagcctactttatcatgccaacaatggtaacaaaatcagccaggtgattacaggacagaacacaggggaaatgactagagctgtgctgtctactacagtggctactagccacatgtggtttcttaaattaaaattaattaaaattaaataaattaaaaatgcagtttctctgttgcaccagccacatttcaagtactcaatagccactggtatcaaacagcttagatttatagaccatttctatcactgcagaaagttctattgagcagtgctgggctctcatgttagacctgattatattactaaattgttaaataaacgtttatcctttagtctctctggtcttgtttttctttatacaacatgtgataagaataataacattcactttacttaccttagggagcacacaaatgttaagcaaaaacactttttagcattctctctagaagaacactacaaaatgtcaggtatctctgtattatttttggagggctcatgaggtcaatgaaaagcttttgaattcttaactaattttctttaagatatgcagcatttccatcttaggtggaacagttttgatactgttgatgtagaaggcaccacatgactggtattgtgctttcccaactcttccactgggaagaaacagcattttagctaacctatggacttaacattgaataaaactgctaagaaatgaccagaatatgaacctaattttaatgaaaggagaacagcaggttgataaccattctttgaacagtaattttatctacaccatttatgaaccaaaagactgacatgaaatataacgtgttaacataaaacataatatgttctttcagtggtgtttacagaagcttattctccatgcaatggtcagaagacatgcacatttaggtaaaatacttctcttaaaacattgtaagacaagttgctacattacaaaagtcatatgaaaatgactgcttgaaatatctttagcatcataaagcactcaattgtgtgattctttcacaatttttctttctccattaaatgacattttgattttttttcaccataaattacatgattcagcagcatggatattagaattaagtatccaacataggcaatgttgatattgtggataccaaggagatgtgcttttctgatagcgactggccacagcgccccatggagcactgtggtagtgcctatggcaaggacagaggaaacaaatgaaggtggaggctcatgtggttttatagtttagaagaggtcagcctatgtgactttaacaggccatcagagtgtatatatttggcttacatttctgcttcgtgtaccttcttttgcttctttgaagatactgacttaagaaagaaaaaaacatgataaagtaggctgttgcaatttaaagaaacaaattagtcattctccaggtcttattctgagagcctattacctgcccaattctatggtatgggattttaatctactggcatagatgtgtgtgtatgcatataagtgtgtgtagatgtgtatacactacaatgaatgcatgaatttttaaaaagtggaatgttgataattgtgtcttgatcctttctctttcctcaaaaccctcaatccgcaaacaataaacacgagtcttacaaattgcaaggtactgtaataggctgcaataaatttgatctagaacatcagggtttttatttcactatctttgcagaaggataaatgaaggtaattcagaaacatgattgctttcttcactctctattcattttattcattgcattaaagatagtttaacattatagaaagtttagaaaagagaggggaaaatcctccattatccaaacgctcaaatataataactattaaatttttatttttcttactgtcttctctatattccttttagaagatgttttacagataaaaacaattatgggataatggatggaaatagacatctgttcctgttttattttctctttttttctcatttaagaaatggaaatgattgcccaaggctgaaaataaattgttctgatttatttttaaaatggatacccattgtttgatttcctctatacatacatattgagagaaaaataaaaatactgacatcatcaaaaaccctgtgactttccacattagcattcctggggattaaaaaaaaaaagctctctttctgcattcacctttttaacttactatggaatttacaagaggtagtaggcggtactgagaagttaatggtagaaatttttctttacgttttggggtatgaattttgcatcagaacattcaaccaatactcattgaatgcataccaataccatttactctacaatttaccagcaatgagacagtgaaagagggagaaaaaccccactcttgtgcagccttcaggctagtgtatgagacataccaattaacagggattacaatctatacaatgctactgagtaacagttggaagttcagagagctatatgggcacattagagagtccaggaagtcataaaaacgtttcaatgaggaaacctgaaagatgtataggagattttcagaaaagtggcagagactgggtatcccaggaaatggggacagggtgtgagttagcttaaagaaaacgcagagaacattgtgcattatagcaatgtgtgtgtgtgtgtgtttgtttgtatgtgcacatggtggaagagagcgagactttgctgagagctgacacctgagaagttggctgggacatgagttatatggagaagagtggcaggaacagaactgcatttcagaaagataattctgcctgaagtatcttctttgtatcataaacaaaacagtgaccagaacagtcaatatagagcagtcaaaagcaaatagactgaatgaaacccatgcttgagaagtgaagtaatgcatagtttctttaataatgtataaatacacattgcacacatacatacacatgcaaacagacatccatgccagaatcagtcattaataactatgatgacatttattatgcacttaatatgtgccaacaattgtacttaaaatatctttagcctcacaacatccttgcactatagacgttgttgtttacaatttatagaaagaaaactgagactcagaggggataagcaagttgctactgtttctcctctgttaaatagacaatatttctctgaacgaaaactcacactgtgtctaccatactatgctctttctctattgaactgtcaacccaagggaataatatgagccattgttgagattgataaattggaaaagcaaacacaggacacatcagctcttaccgtccaacacaaaatagagagttcagcaggctcagtggcagacaggccatataacctgcacacttgcaaggaggcccagagcttcccggtatgcgaaagttcttcccctttaacttctcatatctcccaaaatctaatttgtcaatatcccatttaaccctagaataattttcttttacttcaatctttgttcttacctcatagttcttacagtaaaacattgtaaaagcagagactgttctggaaatggaattgattctgaaaatgttaaccactctctttcaggtttcaattcagcacagtttttcctgcatagcagaaatgaaatacatagacctctgttcattgctttaaaaactaatgcatatactctctgtcacacacagatacacacacacacacacactctaatctgccatttgagaaaaagaaattgtcaagtaaaaattcctagactgatttttctctgctaaataaattcattttctggtttctagtcttggtttttcccaacactgatggtctcataaaactggagtataactgcatttgatttatacatttatacatttacaatttctctcacaagtagtatctcccttgatcctaacgacaaacctgtgaattagaatcacactggaatttgggtcagacatgtgaggcaaaaattcttttcaatgataacaataaaactggttttgctacaaaatagctttttgggtagctactctcacagcaaataatgacagaagtagagcgttttcttgcaataaggagaggataatattttggaatatctgggaggactccctgacagctttttgaagtattttttctaatttcttagtcttgcacttctttttgccattctaataatgaattgtcacatgtcaaagcatctcactttatagaaacttgtattattttcaatagttttcacattatttctagttctgtttttttttattcttatcattaacattttagtgcaaaaatttaagaaggtatttctgagtgaaaacaaaaactaaaattttcccagagaataccattggtattgtcttgctctttttgacttatttccctctctgtgcatatgttacacacacacacacacacacacacacacacttatctcacaaatatctcttaataggttctgtttagaaatattttcatttacctattttttttcaattaacagtacagcatagaacatattcctggtatttttctaaacacagatacaaaatgtaaataataaagagtagttgcccttaatggtgtctaatagataacaaggaaattcggccgggcgtggtggctcacgcctgtaatcccagcactttgggaggctgaggcaggcggatcacgaggtcaggagatcgagaccatcctggctaacacggtgaaaccccacctctactaaaatacaaaaaaaaaaaaaaaaattagccaggcttggtggcatgtacctgtagtcccagctactcgggaggttgaggcaggataatcacttgagcccaggagccagaggttgcagtgagctgagactgtgccactgcactccagcctgggcaacagagcaagaccccacctgaaaaaataaaagtattgcatattgattacattgatgtatatatcatttttggctcctaaaatactgtttctaatgattgtattcttattgtatagtatgggtattgaataaagtttttgctatttaaaaatattgcaatgagtatctttgtagataacactttttatgcattcataataatgttcaaaataatatatttcaaagatttccttacgttttgctttaaatttctttaaaaatctatgcgttattatttttacatttggtatattttaacaactaaactcttacttcataaattgcccatggaacactgcctcagtctcaatcattaatctggtcaattacttgaagtgtttcttcaactaggataatatttcatggttgtatgttttatggtaaaatatgttcacttaacaaatatttagtatacctactgtatttcaaaacgacacacaatgggtatgtaatgggaatcaagtagaacaatgtattgccttcataagaattacagtaatgaaagagacatactgaacaggcaagtgcagtatagtgtgaggattctattgatggaagatatccagagctgtgggagcacaaaagtagaagagcacaacaataaaggtgaaacaattggaagaatgtgagctcatggtgaaacaaagttggctccctctggacaacacctggactaaaatcagggtttgatgccttaggcactgtacttttattacataatcctactcttagtggtcagaaactgcttgttcatctaggggagtggcttcagagcacaatcagaaaatcaagtatctgcacatcaaccttctatctagacagtaaagaggaaacaaagcaagccattctgggcttcatgtttagttggggcacacagtaatatctttccagatgtaaaattaggaagtgaccattttttgtttctcatctgttgcctcttttgaacacaattgctcttcatttctgctcttgtattactttatttgcacttgcctttaattgctcttcttccttatttgtattactttcttaggtccatatcttatccttttattgtgcattttgaattgttttcataattaactttatttctttggaaactaatatttgcacataataggagagcaatagctttcttgatttcatattttcttttggaaattagtttatttctaacaatgaaaataaaaagggtgtgtgcatgttagctggacagaatacaggaaaacaggaatgatctccatgtaccgtcataaaacttctacgaattttatgaattctcaaacttgaacccttgcatttcgccaggttagacctaagttaactgggaaacataatgctttcttctgttaggtgaatttcataaaggtgtaaaagaaggatataatgtgaccatttcatttttcagtatcgttggtaaaaatttatttctagtcattagataacagtggaaactgaaagcagcatgccatccttgagcaaagcagtgaaactgtagccacctgtcttttgtgaaccacactgggagcttaattaaaggaacctgcacctgactcaaactggtttgaataccaatagctgattcattaattgcagaataaagttcttaatgctttaaaacactaatatgggcagtaagaatgtttataccagtagttttcaattaacatacagaaaagcagcttttttgttttctttcttttaagaaaaggacggtcatacagaaagccaatatgtaaaacagataaaatcgggacttctctggctgagattaggttaggttgtcccaagctcccctcccttctcctccacctatccttttggcctccattttcctgccactctcccaatcacctctcaggcatttccatgaaagctctgtttctgctcatcacatttgaaagccaaccgctacactatccaatttgcgacttctgactccagagcttgttcttacaagtaaacagttgtttccaagggacatctttacactgtggaaattatttatattattaatagtagtatgaggaaagatgataagacttcttgaactttaaacatagtagatatttatttactgcttttcctttagctctgaacaaggttgttcaaaaaggggagagaagccctggtgacccctcttccccaacccagtaaagtggattatttcttccagtcataatggattatattattttattaatcaactaaatctataccaacagataagtgggtagttagcaaatataatacttaaagccagagatggtgtttgaataatgagttcaccaggcaaagattagagagggataatagggaaaaaaaaaaaactaacaatgcaaggacgcaatggtaaaaagaacacgttttaggtacctaaacctccatgatgtgtatttgtaagtacaacatttgagtcaggaggtgaagcttgtgggtgactttattgtcctagtgaggattttgcatttatccctatgtggaaggcattggcaggcaagtaaatatgctttttggaaatgttgtttaaagtaaccagagttaactcagcaaatatttcaacagaaaaaaatgagcataccaaaatagaaatttctataaacattaacatgcaagaacagcaaaatattaatgcaggaggtaggataaaatggggaaattatttaagtcatgtgaggcctaataagtgatacagtaaaagggaatcttttttttcacaattctcattgcaacctctcatttacttacattattaaaaatttggtctctaatatgtttcctagttctttgtttaaaaaattcaatatgttcaatccatttttaaagccaaaaagctttctactgatagacttgttagattcctcagtgagtctacctatgcaaagattttccccataggtaaacattctcattgattaaagcacaaaaataataaagcagttagagaatggctccaggagataatgtttcattgactggtgttctgtcagtaatgtgaatgccatcctgttctcattttctccctgaaccctgtagggaggccagattgaataagtaacccccacaaaagaaagaatttctgaaaatgtcaaaaacgcaaaacgtaatttggtctctaaaataattgattactttgcatggacagatccagaagagaggacatagaaaatttttcaactgtttctcccattcacccctactctagtagtcctctgtttctattatcgccatcgttatgtcagtgggtactcaatgtttagctcctacttgtaagtgaaaacatgcaatatttgattttctctgtttgcattaatttgcttaggataatagcatctagctgcatccatgatgctgcaaagaacataattttaatgggcacctggattgattctatatctttgctagtgtgaatagtgatgcaaagaacattcaagtgcatatgtcttttgggtagaaagattggttttgttttggatatatacctagtaatgggagggctaggtcgaatgatagctctgtttaaagttctttgagaaatcaccaaactgctttccacagtggctgaactaatttccattctcaccgacagtatataataattgccttttctctgcatccttgccagcatcttttgctttttgactttttaataatagcagttctaactggtatgagatgacatctccttgtgattttgagttgcatttctctgaagattagcgatgataatttttttcatgtttgttggcctcttgtatgttttctttttaggagtgtctgttaatgtcattcactcactttttaatggggttattcatttatgcttgttgaactgtttacattccttatagcttctggatactagacttttgtcagatgcatagtttgtagatattttcttccattctgacaggctgtctgtttacttggttgatcatttcttttgttgtgcagaagctcttttgtttaactagatctgacttgtcaatttttgtttttgttgcaattgtttttaaggacttagtcataaattctttcccaagtttgatgtccagaacggtttgttctaggcttttttctaggatccttatagtttgaggtcttacatttaaatctttaaacaatcttggttaatttttgaatatggtaaaaggtaggagtccagtttcattcttttgcatatggctagccagctgatccagcaacattgattgaatagacagtccttacctgattgcttatttttgtcaattttgttgaagattagatggttgtaggtgtgcagctttatttctgagttctgttccgttggtctatctccctgtgtttgtacaagtaccatgctgttttggttactgtagcattgtagtatagtttgaagtcagaagatgtgatgtatctggctttgttctttttggttagagttgctttgggtattcaggctctttttttgttccatatgaatgctacattacatttttctagttctgtgaaaaatgacattggtaatttgataagagtaacattgaatctatagattgctttgagcagtatgtccattttaataatatttattcttttaattaatgaacatgaaatgttttttcatttgttttgtgtcatctatgatttcttttaacagtgttttgaagtagttgtccctgtagaggtctttcacctccttggttagatgtattcctaggcattttgtgtgtatgtgtgtgtgtgtgtgtgtatgtgtgtgtgtgtctattgtaaatgaaattgcattcttgatttggatttcagcttgaatgttattcatgtgtaaaaatgttcctgatttttgtacagtgattttgtatcctgaaactttactgaagttatttatcagtcccaggagccgtttggtggagtctttatggttttctagacataggatcatctcatccacaaagaataatagtttgagttcttattttcttatttggatgccttttatttttctctgttgccttgttgctctagctagcactccattctgtattgaatatgattggtgagactgggaatccttgtcttgttctagttctctagggggatatttccaggctttgctgattcagtatattgttggcggtggttttgtcatagctggataattgacaaattttaagcatcctggtgaatttcagtctttgttttaagccctttgtaatccagtgtattttttataagctgcacacaactgtctttctttaaaaaaacaggttatctggagatctaatgtactgcatgagaattatagttaataaaattgagtcataaaccagaaatttgaaaaaaaaggcacgtaggttttaggtaattttgccatacacacacaaagggtaactatatgagatgatggatatgttattagcttggctatagtaatcattttactatgtaaatatatatatcaaaatatcatgttttaaacttggaatatattcaataaaataaaggaataatttaacaactatttaattctcccactgtgacccaaacacactcatgcacacacacaaagctccattatgtttctctcttacttatgaacatttattggttctctagcatccaaactccttagtttgtcataggaaattccttataatctggcttctctctatttttctggcttcaagtttagcctgtttgcgtctacatcatttattctttcagagtaaaattctcatttcccccgcctaataaagtcctttcatgaggtcatagcaacaaccaacttatccttcaagatgcagctcaaatgcatctcgctttaggcaacacaactttaggatcatctatttgctgccaaacactattaaagtgccaagcatttgacactgattattcatgtttactatttacaacttctcgaggtaaggctagacatctccatttcagaaaagagaaacaaaactgagggccaaaactattaagggtctgtgctcggttggttgaacatgtagtgaaaatgtgaatttgtagctatggatgccaagacccctatatatggacctctacattgcatactgtagtttattagaacaaaaagagagaaatctggatatatgaatgatattgaaacctatatgttgaggtaaaagcaaattcaatgttattaagatcaactcctgttcttttgctatttctcctatactaaaactactttttgttgctggtgggaaggaaagggtaaagtcctacaaggcatcaagagttcccacttgggagcttggtgtacatcattaacttataaggaaattacagaagaaggcgaatttttaggagaggaccataagctttgtttttgttttggaatgttatgagtgagtagcagcaatatgcttccatagatatgtacaatagaaaattagccattacagtcagacctagactttcacatttcagaattgggagcatttctatgtagaagaaatggtgaaaatgattatctgaaaaagattatctgattgctgctaattgtgaagctaatgtatagaagagagacttggataaattttgtgatgatttctagatgtctggagaaatgttctggaatacagtcttcacaaatgaaagttatgtttgattaaatgactactttaaattgtaaaactgcatagacatcaaaaggaattgcctaacacatgacagaagacataatgttggtcttagagttcagtggttctttcctaacgacacctatatgaagccctgttaggcagagttcatcagttaatctctctaagcctcagagtaacaacagttattaataacaacagcaataatgtactcatatgggaccacttgtccttgggcttcctaggggattggaaggaataaagaaatggtgccatattgggggaacaattgaagttgcttgcttgatagatgttgtgttccaaaacttttggtctggcattctactttgtatcctgtagtttattagaacaaaataaaagtgatagatctgagataacaatgatgttaaaacatatttgttgaggttctataaaagcaaataaaatattgttaaaatcaattcaactcaaaacttcaaagtaatttcaaacttcagttgtgtcccatttttttttttaatttaaacactgtcattttacagggaaaatgacaaatctaggtcattatattatcaaatgaaagctcttaaatgctttactaagcttaaaagttttcccatagggcaatagaaccattgaaagtattcttgtgtgagaggcttatgtttaatttatgaatatataattttaggaaaacctttgagggccatcagactagaaactggtgttggcaggaagcaggaagccagtccccactgcaattttcatgcccagaagaaggaatggatgcacttatctgggatttaggatgaatgagactcgtcaaattgtatttcctgctgttctatttgtttttagtttgaaacagacaaattacactagaaaagttgaaagaatggtacaatatatactcatatatccctcaccaagctcaccatttgttaacatcttaccacacacttccctcttgccaaatcatttgaaaatacactataaatgtcatgacatttcatcaataaatattaaaatgtgtatattttcagaatgataaaattttctgacacagcctgagcatacttacagcacaagtcaacattaatttactatcattatacacaggccatacaaatttccccagttatctaaaagatgtcctttatggctgtgttttatgctttgtctttgcatttctgtgttttgtttttgtttttatgtctaaaatccaattaaggtgtatatatttgcattatttcttcctagtcacccttcatgaagcaactgtcttcctcatgtgaatttttttgtgtaacattgaattatttgaaaagtcctggtccgttgtcctgcagaatatcttatagtatagaaaggcctatcttctaatgagataaacttacacctaagatttcaagcaagaatatgctattggtgatgttgtatgtctcccacatcatcgcatcagtaggtatatatgtgccattatttggttaagattctgaccatcaaatatctccattgtaaaggaatttttaaactttgtaaaattaaaatttatattatgttccctaacatttgttaggccaaataattgactatagttgttctacatttacagttggcattcttttttgtaaggaagctttttcccgctttccctcccctcccctccccttccctctcctcctctcctcctctcctcctcctcctctcccctcctcctcctctcccctcctctctcctctcccctcctctcccctcctctcccctcctctcccctcccctcttctcttctcttctcttctcccctcttctcccctattctcgtctcttctcctcttctcccctcttctcttctcctcttctctttctctctctcattattatgtatatatatggcttatttctttaagttcaaatgtgttatgttccattagtttcatgattatttttgatattcagagtgttccagttttgttaatggggtcgcctttaaactgacctctgtgtctttttcacatgtccccattagactttgagcatttctttattttctggcacattaaggtgcttcaggctcaccttgtacttttatttgcctcagtatgaaataagcaattttcagaaaaactttgcttcttattagtataaaatgacttatactaattaaaattagtataaaagatctttgtttagaaacaaagatctaagtttggagtgtttgttgcctcttggttgtttcattgtgctttggcccttttgatgatagagttagggggaaaactgtgcgtatgcacttaacacattgtcacatatgagtgcacatgtaagtgtgttcatactgattgcctcaaatgaaattcagcattacaaggttttgtttctcatcttctgccatttgatatttgtatttctctgtttctatagtgaatattcttatttatcaaaatatgtacgtttagtcactttttttcaatatactcagagtagcttcagaattgcatcaccaagactattatcgggaaatcaactaatcaaagttcaatattttttcagtttttatttttatgctatactttccataggtttatagtcaacatgatgtatttcagagttacttgaattattttttccatatgtttatggaatttaatgttccattaaattttccatatgttactattttgcatcatattaggattatctgtatttatttttattaaatttcagttttattttttatattaattttgagtagtaagacattattgttcaaaagataaaactgtataatgggagcgctttctcccatcaccattcccattaaaaagtcttcttttccccaagcaaatgacaaaaaaaagaaaaaaagaaaaaaagaaaaaaaaaattgtccctggaggctgaattgcttttaaaaggtcttccaaaaaaaaaaaaaaccatgaacctgggatgagatcacactatgtgagatgatttcaaatcaggaaaaaaatgggccacttaaataatgttgcaaatagatgttagaacacaaagaaaatgaaaattggtttcttcttcagagttatggaatatatcacctaaggcctgggcactaatagaagactgaatctgattcatttgggcaggcgtatttaattttgtgttaagaaccctgacgtttaaaactaggccactaaggtgtgagagaaatcagtaagcttcattgaatgatatttgagcaagataacacataatataaaagacattctacaatctgattccttttattactgaattcttcactcttcatgttatatactttgatctttcaactactgccaccccagcctatgtacagttatttgcacatggtctgctgcttctcacttctgtacttttagccattgtttgcaatgctcctctgacttattttttcaactaggaagctactacttcttaatagaagttttttttagacatcaggtacttctttcccttttctatttctcaacatttgtttattcattatgtactaaatgtcaggtgtgctcatattgtttcgccaaacacgcgcacacatacgtattagaatattattattctaatcatattggaattattattctaatctagtgttgtgttcgcttatctgtttttaaaatgtgagctacttggtttaggataatgctgtacatggagttatccggtaaatatcgttaaaaggccaagtgagaattactaaagaaaaatgatcatgatttcttcctttgttgcccacatatgcagctaaaatacacacattacaacttttaaaagttttttgcttcatttggcctatttttctctactgttatcttcaggagccatgataggataatgttggtgcatctggtatgtttgggtttcatgaaaatatgattaatgtgggcacccttgtatcacttgattaaaaattattttgcattataaaagtattattttaaagtaagcacaccgggtaccaaagttctggtagttaaaaacaaaacaaaattgagtaaacaattaggccttcagtggtgaaatttagagaataaaatttgaatatatatttggtgatctcaagagaagagaaattatttcagatgtgccagaataaaacagaattcttgagtcatccacagatgaattagtcataaactaaaaatatagaatatgcaaagaaaaaggaaaattattgcagaagataaaaaatagagcaattgtgaatttaaaatatactgcaatcaagaacattttaggcaaatatcagtagtgcagaaaacagtacaaattcacagttatggagagaaaagagaatatggactagaatccatcctggaacatgttaatggagacagtttgtttgataccatcttgaaagatgcaaaccttatataacttaggaaatcaaaaatatatgtaagcttttctaaatttggtgctgatatatagatgtaaaaacataatccaattttaatattcgttaaaaaaagacattcaaatgaatgacctacttttacttgaaccctgttatgtggaggtgagatgagaagacagtgagtagataaacagtgtttgtgcagaggacccagtgaatgagaatgactggatttggttctactgcttgctgaatatgtaactttatacaaattacttgacttctctggggtgtaccttcttctttaaaaaaaaaaaaaatgaagtaatacctcataaaaatattgtgcgaattaaaagtatataaaaagaattagtacaatgtttaacactaaatacagacccaataattatctttttctttttcttgttgaatatcaggctctgtttcttaagtaaattttctaaataatggatatatagtccttcgtgtatgaaaaatataaaagatgtctctcccatttaaaataacaatgtattgctttaaaacacaaaaatcaaagtcatactaaatactttcttctcttcctaagaggagtaaaatgtgataaggctaagagcttcttatccagcacacttctcattataaatatttggttcctcccagctttcttgacatacaactgacaaataaaattttatgtatttagtgtataacatgatgttttgatatattgatatatgtacacattgtgaaatgaataaatcaagttaattgacatatccatcacctcacataatcattttccttgttggtcgtgagaatatttaagatctaatcttatagcaattttcaagtatataatacattattttcagctctaggcatcatgctcattatgaatatttgtaatcacattttattttaattcaactgtgctatctaaagttattgaatcattacaactgtttgcctctttagaaaatgacagtgatagtgtgagatacaatttcatgcattacttctcctgtttgcccacatatccactggctttgctcacaggtattagtatgtgaatataacaaacacctcttctaattttctgcttctattctgcagtcatcttggaaactggaggactgaatttgctttaaaatttgtctataaaataaaagatcctctactgtatttgagggcctggtggactctcttgaaaaagacatgcagagtccaacaaacttgtgttacagaatttgtttggaaacattttgtttccttctagttaaaagactgtattttgtgtaaatatccagccatgtgaatgctgggtaagagaaactttactataattgttcttatttggttaatatgttataatactactgataaatgaagctatgcaaattgttagcagaaaggatgaaggctgtgttgtcattgtttagaaaatgagaaatctgtcagatttcaaagtcattataaatgttgaaagaagacaagtaaagcaaatataaatactgtattactttatctacttctcaaactataagtttttcatactctatacagagaatatcattactaatatcatttactatttatttgactttaagtaccataaacgccagtatatgtggtagcatgttttatccaagaaatgatgagaacatttccacatgttaaggtcaaacccagttggtccctctgagctcaaattaagctcaatactcacctttcttaaagattccagactcaaatgaacatgttatagatcactttgagttgtagtgagtttttttaaattactctcaacaatgctacttatttgttctataataaattgtaaattataccatagccaatattggaacttctctttgggaatcttccagcttctaatctttccatcctccacttcctatacttcaaaaactaaaacagctaagcctaaaataccattagcattcaaagtgattactatttcataaactatgtccaggctttgctcctttctcaatgttgggctgttcaattttaatatttcaattggtccaaacaaaactaactgaaagggtaaagtgattgggctttttcaatgcccttatatcttggtgtttgtttatgaataaatgggttaatgatatttttattaacgttcataatgactgtttaaagttatcagtttaaaaatattacaggtaggtattttaaacttagctttttatccaattaatatttccatccttcatatcaagtatttgttcttaccatgtgtcttgtttagttttatcagctttccttggtttatgttaaaagatactttatttcacattgttttccatgttttcacagcttttctttatttgacatagtagtaaacatactagtaaacagaagaaagtatgagagattataatgagaaaaagcttgatgacccagataaatcttactggtattggcctaatagtcaaacctcttttttcctttaataaatgtttttatttgttaagttttcacttaggcttaaaacaatatggtcatctggctaataataatactcaccatacattgacttcttgccaattctaggcctttatttaaatatttatgttgttattttaaatctcttacaaccatcctgcaaggaagatgctagtcagattagcaacctaaatcttagggaatttaattatcttgatcaagtcacatagctgctgttggctgagacaagatctgagcgcaagtctttctgacacacttttcacacctgcctgtagtcttgtacctgactccattaatcatcagcttctcctcttggctctctattaataattagaaaaatgaactgtgggatttactttgtagaataatatgtgacaaaagcattaaaatagatttattcttgatgtcatctaaatgttgtcaaagggactaggattagttgggattgtatttagtttaatttttaattagtgttaccccaaataaattctgtactaatgaggcaatattctcttttcagaaatgtttgactgtatctttttaaaaatcttttaacaaaaaatataattaacgggaaataatatatgaacaacctaaaatgtgtggtttataaatgaaggatatccatcctgtaaaatatgtattcctttgaaggtcttcaaaaagagtatttcccttttcattcatccgttgaaggagtgaggctggaacacgagtcttatcctgtgccaagctgccttttgttgtagtgagggacttttgaccatcacactcttcctaatgggggaagtttacaccttgctcatggattttcctaaagaaatctctatttagaatcacagttgctcatattaactagggcactacctttgggcctaagcaagcaagattgatcattccttctctgcccctttttagcaatgtaacttgctcagcctcatttccttatatgcaaaataggaagtcagtaattggaagagtgatgatttttatttatatataaattatacaccacacacacatacacacactatttttttgtcttcatctatgtgatctttcttcactattctaaacattcttgtcaccttatacattccttttatttttgtcactttctaacctgaaaattgacagccaacacaattgctttggaagagaacatggggttgtggagaaaactaaaatcagggtctaaaaatctcagctttgttgttagtgaagttgaaagcttggtgaagtcaccaaatccttatatgtcctaatttttctcccatggtatggggacattaacagtttgatagcagatttatagtgttcatgtgagaattaaatgaaattgctaatcacaacagtacctagcacagtgcttgagatataataggcccacagtaggcaattgacaggtattaatttgccctttcctgttgcttcacgaaagctttagatcatagaatttggcaaaccttattgtctattgacggcctgtttctatagtccagtgtttttcagacttaactttcaactccttttaaaagaaaaacatttgcctgaaatcctgccactaacttatgcatttttattataataatatttaaaatataaaaccattgcattatgaattagaccctaatatttataatgtatattcaattataagaccagagcaaattttcaaataaggtttgaatacaattaaaataaaataaaattcaaataaaatcattaagttaatgtgattgaggatgttatctttctgaaattaaatcacgatgtacaactgaatgtagtactggatatacttttgcattcatcgtgcttctacctcaccatgttatgtggtgacttgagtctcttttcacttaaattattcaaattttttatttcagcattgggtcctggtatgatttaaccctcacctggtgcaaatgcatcatgtaaattttgaatagccatttgtattttcctgaaaaataacatgacaaatagagcagctttgggcactaaagatgtgcaatacttagttattaggttatcatccggaagataagagttattaaccttgttaggttatctttgaaatcaattgacagtttgacacattcttagagctcattgtgaactctattatcaaaaaatagagatcacagcttgaaaatctttctgtattaaaagaccaatacaggaatcaagaagaaggcctctagtaattgttttgatgattgtgacttatcaaaatagtaaaaattagagaagtgagttgtgtggcagtgtgaaatgaagattttttgtttgctttttttttctttttacttttatgatgttgaatcccttttacaaagaaagaaaattatcagcaagataaagacagatcttattatctgtccttaaaagtccttttctttttgctagtttcttagggtaagttttaattttaataggcccaggtctggttcacttttatatttccttcagtgtcaaacatatgtaagagatgttccaagccctttactgaagaaaggagtaattttattatctgcagaatattttaaaagatactttatttttaccccttggagtgatttaggtagcctatgtgaaagcaaatgaatgaattaagtaacattctcaaacatgtgtgatttcttggtttcattgatttgaatctagagcagcagtaagtaatggatagaattaagatagtaaaagttgacttatgcaattgtgtggtgttagattgatttacgactcaaacgaaataggtcttacaagtaagactaaattgaatatgtgacatggagtgataaattgagaacactactgaaagtatttaaacttttaaaaattgaagaaatctgtccaaagagtagcacattcatagattttgagagataagatagaatatatgagcagttgagattgcttttaatttggtctcaatacatcagtttgaagtttagcaatgaacagtaagtcaggagagtcccagctgatgcagcaaagacctttcaccaatagaggaactccagcttatgtactttcacttacaccttcattgctgttattattattttttaattatgaactctgcacttagttagatgttacttgaggagaaggataacacaattctgttccactggcaaatcaaacatatgcttagcaaaaaaaaaaaaaaaaaaaaatgccccaaatatttgaattgcagacctgaggtattttctgaaaacctctcaattttttggagtttattaaaagatagaaagtaatataaagtttaaatgtaaattacttatgagtgacctttctgaattgcccatttggaagacttgtctctgagatgatttaaaagaatctcagatagtgtgttttccaaataaaattgattttttaaaaggtcatacacatgatttagagatatgtgggtcaaggagagaagataactaatttcaaataaaatgtttacagtttaggcggtctttaatgaaatcctaccaggcatttcggcaacatcaaacattagagactttatttaatgaatcaacagggaactgaagcttccatgttacactgttttgtctagagtgaattttaatttgaagtgagccaatgtgatatagaaatattggtaaccttggaaaatgtctacagaaccccttcttattcataaaaaatgatttttaaattaccaaaatatcatgtcctaaatatgacaactcttaataagttgttacatatatagctatttatctctctgtgaccattctgtatttacagatataaaacctgcttattttttatatatttatataacatcttattaataacagacacaacagcagatataataactaaactggattaagtgctcactatatatgaggaactaggctaagcatcacttacacatattatgaaaatttccatatcactagctaactatgtgcatatacactgtaagttttgatagctgcatagtgtgttattatatgattataacttttttagccaataaactgttgttaggcatttatgtaatttccaaatatttgtgtttatatatactaacataagattctttttaatttgtgcatccaaatttattatgtcaggataaattgtcagaagtataatactcaaaccaaaacatttacatgttcctttgaaatttcattatttagctgttgtatcaaaagataaaaaatagaaaacagggaggtttttgaaatggattgttgaactgtaaactcagtaatcccatgctggtctatacacccaataaaactttgtgagacttccttccctacatccttgctgactctggttttatgtgttttagtctttgatgagactggtcaatcttaaaaacagtcaggtttattttatttatggatgcactcaattgctactctttctcctaatagatgagatcaaatattaggatatcttaattgatgaaccatgcagtgtgttttcatgacatatataatgtgtttatatatcagagacagtagcgaagatataaataatactatcattttagttcaaaggtgaaccatgaaaaagcctcaaaaatatttcagcccactttcttcatatacagaaataacaaatggcaatataaataagaaataaggtgagatgtgacatcatccacaataaaataattctcagtttatgatatagagccggtacaaaggaaaaacaacaacaataacaactgtattttatctcttttagagccctgtgtggggctagaaattcacaagtctctgtctttgctcatgctagttcctcaacatggttttccagccctgcttttggtttcttctttgcctgtttacattgtacttatcaatgggacccagatcaaaggctagtgtctgtttgcaccttccttaatctctctaattaggatgatttttttttttttactttggttctttcaatatgctttctctatctttgtgttcattttaattttgcatggttaggtgttaataaagtcatttctctcatttttatgcatattccttaaagtggtatatattttactcaattgtgtagcataatcagaactcaatattacagtgactggcaaagtacataaaatatttgttgaatgagtaagatgaagtgttttatttgtaatgcttttcagatagcatatagtatttgaaactcattggagaatcactaaaaatgacactgaattattttcaggagaagttttaagcttttcatttgaaaatagtcatgtatttacctatagcacatataatagcatttaaaaaaactctcattaaaagaatgtcctccatttttatatacctgtatataaaatataattgtataaagcatgctttgtatactttccacctctagaaataataaaatcagcaactacaatctcccattttttttaaagaaagacctactacacttcccttcatctagaattgaaatggttcataaatctatttacttttgttctctaccattaaggagttggcaatatgaggccgagtgtggtgactcattcatgcctgtaatcccagcactgttggaggccaaggtgggtggattgcctgaggtcaggaatttgagaccagcctggccaacatagtgaaaccccatctctactaaaaatacaaaaaattagctgggcgtggtggcggatgcctgtaatcccagctactcaggaagctgaggcaggagaattgcttgaacccaggaggcagaggttgcagtgagcaaccagaggttgcagtgaggttgcagtgatctcaccattgcactccagcctaggcaacaagagcgaaactcccatctcaaaaaaacaaagaagttggcaatatgaggtaaagttgtatttgagggccacatgacaaaagttgctttccttttttccttgaataatgcatcagataatttacttacttatttatgtatttattagagatgggatgttacttctgttgcccgggctggaatacagtggtacaaacacagctcattgcagcctccagctcctgagctcaagcaattgtcctgcctcagcctcctgagtagctgggactacaggcattcttcactatgccaaactaatttttttttttaattttggtgaacactgggtctcactatgctgctcaggttggtctcaatctcctgtcctcaagcaatcctttctcttccgcctcccaagtcattggtattacaggtcactgcacccagcacaaattattttttatcacttttctttacttacattaagacagatgctccttttttggcatgtcttattttctttgagcttgagaaacataggcaccaaaaaacgtttggagagatgacagtttttttctgcctaacaaatttgactgtgtacattttgatttatttctttgaaacaccagtctgatccaataatcttactttaaagcaaacttgggaaacagccaaactagaatccttggtgtgcttaaacaaaacccaagtgtttgagaataaaacatgtatcacttatgcatatagtgattcagtccagatgaactgggaaaacttgttctcatttttttgaggcctctcttgaccaaactattcatatgtaattagaagccacatatagagcttcactaataagtaataaatgcatttaatttcatattgttacctattttaaaaatgaagaatttgggggtctcattgacaaacataaacttaagtttacaagataataaaatacctttgaataataacacaaaatgcttagtcatgtaaaggaacattaagaaacccaaattctgttgccggacttttcgttagtattaaataggccattagactgaacaaaagcttttcatgataaattagaattgccttagagtttttatcttgcttttggatatatataggatagtttaaatatgaaaaactaaatttcccaattaaacatatgaaatgtatttttaatttatgtatttcattcatgtttaataataaagatgaaaagtaaattgtatgttgttaattgtttaaatcttgctttacaaagcatatttttattattgggcttattaatatttaactagtttaatagtttaataaataattttctttaaatgataattgaagaactttctttagtcttagttgggtacacctatccatgggagtgcaggctgaccaataagccagaaccaaggacctatcagaggtagattgtaggctctaatttttgagcaacagtagtgccatgatttggttattattattccaatttcacatgatgaatttgaatttagatatgtctatttacttgaccacttttttggtgagagaaagagcaatgttatcaacttaaaattgtctaaaactaaatctcatattcagcagccaaagtaccaaagaaataaactcttgagtgtgtgtgtgtgtgtgtgtgtgtgtgtgtgtgtgtgtgtatatatatatatatacacatacacataggtacaaaccaataagggaaaaaaatttcatccatatttcttactatccatttactgcactgataacaaacagtgtacattttaaaaatatgttggtatatgttacacagaaacttataaattaaaacataaaatcacagacccacgtttggaatatttaataaaatatctaaacattacacttattgagctggacacagcttagaattgtttgaactagtccttccaatgtgttttggcaaaacttataattgtctttttatcagtgattgattcagaaaacatgtagtgaccaaaaactacaataaatttaaggatattttaaaatgctttgtgttcttgtaaatcacagtaacatcaccactcattatgaattaatagtacatatatatatacatacatacatatataaatatatatatatatatatacacacacacacacacacacatatgatagattgtcaatccatagatgaaacttggtacacttatggattcacagacccacaactactctttggagttgcagttatcgcaacccacaagtgtggaaccacagtgaagtaactggggcccacagtaaccacagatgaagtaactggggcccagagaaatgattcgcctacaattatataactggtaagcaccttattacaattaaaacccagaattcctaaatgttggtcttacgtacttttccctacaccaaaatttctcatcaattttgttgatatctcctttgagaatcagatgccttttaccccagggaaatgcatatgtgcccatccatgtgaaacgctgcacataatcctaagagggttcacaaaccttttagggtctactcatgagcccctggtaataacacctgccgaagctaccaccttaatttctatgttaaaaaccaaggacagggtgggctaccgggccctgcttctgaagttaagtgactgggggggctttttaaatcatatttttaaagtgtacctttcccttaattttaaccaggatcacttgatcatcataacgtgcatgtattaatggctttatttgagctattaataatgtccttaaaaatatttttaagaaatctgaatctcactgttatttctttaaaattaattgaacacacacacaaacaagagaaaatagaaacttaaaatccttcctgtctatactggtggcttaactttgtgatgttttcagtagtaaagccagcctttagcttggagttcataagtattgagaagcatgatcttcctccagagaaagtgcctaccaatttgtgtggattctggttgccaagagacaaagtttagtccattcaaattaagttcaatggtctaaaaattgccaattttatgataaaatgctatcttttgtggtagaaaatgtttatttaaaatatttaggcctttaacatgtactcttctttttaaataatgacaaatatgtgcaactttgaaattgagggttttcttttactttatctttttcatttgtttgtttctcattcacattgcaaattcaaaataatgatgccaaacagtcaaaagaatctaagtctgaggttttacttctagaatatattctttctgccagacattccaaaggctttaattttaaattctggggtatttggctacgtgtaaatagccctagaagaatcgaaataaggccaacaggaggagggagcttcctgaactatattgacttccttctttttggttcacctttagtttttgagcattccgctaagttcatccaaaccaccccaggataaagagggttttctttatttaagatgtcatgaggctgacaacaaattagcattgcatgcactgaagttttagtctcctgaaaagaaaggctacaagaaaagaaattggtcatagcattttcctgtgaatagttcaaacatgtaaatagttgaaatgtaaatatttaactgttagttaaatagttgaaatacaattatcaaataattaatttatgtagtcaaaatagatggactagattcactcaatcattgaacaagtatttgctgagtagctcccatagatgtaaagagccattctaggtgtgcgataaacaatgaacagaacacagaactgccctcatagggttaacattttggtggatcttagattgatatcatttaagaaatagatttctctatgatttagaagtctagttccaatggagcatactgtaagatctgggaaaacaaatcaaaaacagtcattttgaaataaaattaatatagatttgtagagatacaggtgaaaattctagctccaatgaaccaaaagttgagttgctaaatagacaaagtagtctttaagcaaatacaaaggtatatgtgaagagataaagactgaatggatggaaaggtcaagttttatatgaacaccatcagtagatatatacgtaagttttgtatgaacactctctgtagatataaacttaatgcctggatgatatctgtggctatcattttaaagcaataagtacttattttacccataaaatgttatctttcaacatgctagtggtaatcacagtgaatttgtactacttttcacaactcacactgtagaaaacaaagtataatttgaaatttgactttagaatagcatccaggggagtcagcctggtttttgattttagaaggatttggttttgaatatgggctctgcagactgctgcttgtgaccttatctgtaagacacagaagtaatgcattcattgagagtttagggaatcaaatgggaaaaggtgcaggaggcacctaacatagtgttgtgcatataatagctggtcaatcagtggctggacatttgtatttacaggaccagaatttggatttcatgtgcttgatttaatcctggctcctttaagagtgtacctagctgcctccagatatagtaaaagggaaagttttaatgggcaggaaaagaagaaatgtgcctcacttttttattttttttgagactgagtgttgctctgtcacccagtctagcgtgcagtggcacaatctcggctcactgtaacctctgcctttcaggttcaagctattctcatgcctcagcctccagaggagctaggattacaggcatgtaccacacccaggtaatttttgtatttttagtagagttgtggttttgtcatcttggccaggctggtcttcaactcttggcctcaagtgatctgcttgcttcagccttccaaattgctgggattatgggcatgagccaccccagcacccggccagtgccacatcttagaacactcttgaggtgctttttgatttttaggtaagtgtttaaacccgtgtaatacattacaattgactcagtaaactattatctatgccttgaaatttggattaggaacccctgatggtgaataaggttatgttgtaaggatgtgatatgtcaaatatcagagagaaatacatgacgggtcagcaattaagttgctaatggggccaagcatagtacaaagtaaaggcagaggatgaggtgggactttgggagatgaagctagtttctaaggaaaaggaaaaaaataaagcagcaaaaagtagtcagtatctctgatcttttcctcaactctgaaagagtaatagctcttttcttgggcactaaaatcacatagagacacagtggccattttataagtgtcagttattttatcattattatttttatttaaatcatgacactgttgagctaattaaatccttcctgtctatcttgaggccaatcgatcatttctttgctttggtatctatctatgtttcaacaacacgtgtagttatatataactacataattttaataaaaacacatgatccttataactcttcaggttttttcctagctgaagtaaaacatctgtgagatatttacagcttccctcccccaaaatgatttttttaaatttatttttattgtgtatagttaatatatacaaaatgatattttgataaacatatacatagtgaaatgcttactatagataagcaaattagtatacccatcactttccataggtgacttatgtgtggtgagagttcctaaaatctactttcttagcaaatttaattatataatacaatattattaactgtagttaataatattataatgctgtacattataatattagatatctaaacttattcattttacgtagctgcaagtttgtacatttttgacttacatctccccattttctcttcctctgtgtccctggtaactagtgttctactttctgtttccatatatttgactatttcttacaatcgacatgtaagtgagatcatgcagtatctattttcctgtgtctggcttatttgacttagtataatgtctttcagattcattatattgttgcaaatggcaggattgccttctttttcaaggctgaatagtattcatttgtatgtatatataaaataacaatttatttatccactgatggacacttgagttgttttcatacctttgttactgtgcatgatgctgcaataaacatgggaatgtagatctttctacaaggtgctgacttcatttcctttacatagatacctagcagaggtattgctggttttatagtagttatattttaaaatttttaaggaagctccaaactattttccaaaatggttgtaccaatttacattctcagaaacagtgtacatgagttacctattctccacaccctggctaacaatgattatttcttattttttttttttgattatagctatactaacaggtgtgaggtgatatctcactgtggctttgattttcatttccctgatgattagtgacattaaacatcttgtcatgtgtctgttggcaatttgtatgtcttccttagaaaaatgtctattcagaccttttgcccatttttagtatttatttatttttccctttaatttttttattttaatttttatgggtatatagtaggtatatatattaatatgtatgtgaatatatattcatatgtatactcacataaatacgaatatatatgaatatatatattcagatatacgaatatatatattcatggggtacatgagatattttgatacatggatacaatgcataataatcaaatcagagtaaatgagatattcatcacctcaggcatttatcctttcttggtgttatgggcattccaactatactctttttgttatttaaaaatgtacaataaattgttgagtgtagtcaccctgctatgctatcaaatactagatattattcattctatctaactatatttttggacttattaaccaccccccttttcctctactccccactacacttcccagcttctggtaaccatcattctactgtctactctatgaattcaattatttcaattttttgcccctgcaaatgagtgagaacataagtttgtctttctgtgcttggcttatttcacttaacataatgtcttccagttccatccacgctgttgaacatgacagggtctcatttttttatgcctgaatagtgctatcttgtgtatatgcgctacatttgccttatccattcatctactgatgaacacttcggtttgcttacaaatcttggttattttcaataatgttgcagtaaacatgggagtctaggtatctcttcaatgtactgttttccttccttttgggtacataccagtaaaatttctgaatcatatggtggttttacttgtagttttctgaggaccctccacactgttctccatagtggtggtagtaatttatattcccagtcttttatatacttgccagcatttgttatttcctgtcttttggataagagccattttaaatgggtgagatgaaatcatattgtagttttgattcacatttctctgatgatcaatgatattgagaaacctttcatttactcatttgccatttgtataacttcttttgaggaatgtgtattcagatattttgcccattttaaactggattatcagattttttactattgagttgcttgagcttcttatatattctggttattaatcccttgtcagatgtagagtttgctaacatttttcccattctatgggttgtctcttcactttgttgatcatttcctttgctgtgaaggagatttttaacttgatatgatcccctttgtccatgtttgctttggttgcttgtagttgttgggtgttactcaataaatatttgcccaaactcatgccttagagcctttcccagatgttttcttttagtagttttgtagcttaaggtctcagatttcagtcttgaatccattttgatttgatttttgtatacggcaagaaaagagtatagttttattcttctgcatatggatacccagttttccaaacaccattaattgtagagactgtcctttccctaatgtattttcttgactctttagtcaaaaatgagttcactgttgatatatggatttatttctgtgttatctattttgttacattggtctatgtgtctgtttttgtgccatcaccatgctgttttgtttattatagctctgtagtataactggaggtaatgtcattcctccagttttgttccttttgctcaggatagcgttggctgttctgagtcttttgtggttccacataaattttagaatactttttctacttatgtgagaaggtaaatggtattttgatagaaatttctttgaatcgcagattgctttgggtgttatgggcattttaacaatgttaaatcttccaatccataaatataaaatattttcaccttttttgtatcatcttcaatatcttgcatcaatgctttttagttttcattgtagagatctttcacttttttggttttttccttgggattttattttatttgtagctaatgtaaatgggattactttcttgatttctttttcatatttttcactgttggcatatagaaatacggttttttttgtatttttatttggtattctgaaactttactgaatttattctaaaaggtttttgatggcatcattaggagtttctaaatataagttatcatctacaaatgcagataatttgattttttcttttacaatttagaagccatttacttctttctattgatggctcttactaggacttccagaattatgctgaataacagtagggacagtaggcatccttatcttgttccaaatcttagatccaaggctttcagttgttgttatgttccttctaagcccagtatttttttttttaaatggagtctcactctgtctcccaggctggagtgcagtggcatgatctcagctcactgcaagctcagcctcccgggttcccaccattctcctgccatagcctccagagtagctgggactacaggtgcccgccaccatgcccagctaattttttttgttgttgttttttactagagacggggtttcaccgtgttagccaggatggtctcaatctcctaaccttgtgatctgtccgcctcggcctcccaaagtgctaggattacaggcatgagccactgcgcctggcctaagcccagtattttgaagatttttaccataaaagaatgctgaattttatcaaatgccttttcagcattgattaagatgatcatattgttttatccttcattctgttgatatgatgtatcacattgattgatttgtgtatgttgaaccatccttgtatccctgggataaattccacttggtcatggtgaatgattttttttaacaatattgtttttaatcacactatttttaacacagtgagatttcactttattaaaaaaaaaacgcagtggtcttttaagtgtggaatattaagatattttcaggactgagggtacaatagattctattaatttgctgatatctcattcacttataaggaggccagctttgaaagccattataacctgcacatatatgtttttaaaaaataagaatgccatacacttatgtagcacttttcctgtcaaagtagatttgttcctattttccattgggtaatgtgaggtgaggcaggtattgtcactgggctctcagagaacaagggttgataggtgcagcaaaccaccatggcacatgtatatctgtgtaacaaactggcatggcacatgtatcccagaacttaaagtaaaatgaatgatgtttttaatgcattggtgaatttggtttgctagtattttgttgaggatttttgcctctatgtttatcagagatattgtcctgcatttttgtttttttgatgtgtcttcgtcctgttttggtatcaggatattactggcctcatagaattagtagtacttccaatgagtttggaaatattccctcctcctctatatattggaacactttgagtagtatttgtattagttcctcataagtgtttggtagaatttagcaataaatccagtgggccctgaggtttttttttttttggtttttttttttttttggctgggagaatttttcttatgactttaatcttcttacttgttattggtctatttaggttttagatttcttcatcatttgatactggtaatttgtatgtgtctaggaatttacctgtttcctctaggttttccaatttattggcatatagttgctcatagtagtctacaatgatcctttggatttctgtggtatcagttgtaatatcacctttttcatctgattttaaaattttgatcttctctcttttgtttttagtctggctaaaggtttgttgatttttttatcctttcagaaaaccatcttttcatttcattgatgttttgtattttcccctgtttcaatttcatttacttctgctctgatgtggattatttctttttttctaccaagtttgagtgtgccttgcccttatttttctagttatttaagatgtgttattaggttttttatctaaaatttatatgcctttttaatgtaggcacttattggtataaactttcctcttaacattgctttctctgtatcccatagattttgggattttgcattttcattttcattggcttcatgaatttttaaaacttttgttttaatttattcatgggcccactggtcattcaggaacattttgtttaatttccacgtgtttttatagtttccaaagtacctcttgttattgctatttaatattattctgttgttctctgagaaaacacttgatatgatctcattttcttttaattttgtgagtcttgttttgtggcctaacatatagtctatccttgagcatgatgtatgtgctgaggaaaagaatgtatattctgcagttgttaaataaaatattctgtaaatatctattagatccatttgatctatagtgcctattaagtctgatatttctttattgatttcctgtctggataatctgtccaatcctgcaagtgggatggtgaagcctccaactattattatattgggatctatcactctctttagctcttataacgtttgttttatatatctgtgttctctagtgttaggcgcatatatatttaaaattgttatatccacttgctgaattgacccctttatcaatatataatgactttctttgcctctttttgtagttattgtcttaaaatctattttatccgatatatatatatatatatagctactcctgctgttcttcgaatgccattggtgtgggatatctttttccatctttttttttttcagtgtatgtctttataggtgaggtgtgtttcttgaaggcagcatattgttgagtttagttttaatgcattcagccactctattttttttattggagtgtttagcctattatatttaatgttattattgataaataaggacttactactaccactttgttatttgttctctggttgtcttggagtcttctcttccttctgtccttcctgtcttactttttgtgaaagtgtttttctctggtggtatgttttaattttttgatttttattttgtgtgtgtgtgtttttatattttttaggttttttgatttgaggttaccatgaggcttgcaaataacataactcattactttaaattgatgactacttaactctgattgcaaaaacaaagaaaaactaataaaaactctacattttaacttcatacttcttgctctttaactttttgttgtttctatttatatcttcttatactatgtatgtctttaaaagttgttggagttattatttcagataaatttgtcttttagtcttcctactcaagatatgagtagtttacacaccacaattacagttacagtattttatatttgtctgtgtacttatttccagtcagttttgtactttcaaatgatttcttattgctccttaatgtccttttctttcagattaaaaactttctttaggaaagatctggtatggatgaaatccctcaggtttttttttaaattaatttatttattattattatactttaagttttagggtacatgtgcacaatgtgcaggttagttacatatgtatacatgtgccatgctggtgcgctgcacccactaacttgtcatctagcattaggtatatttctttgccaggggaatttttttatttctccttcatgtctgcaggatattttcactggatatactattcttggataaaagatttttttgtttgtttgtttggtttgtttttgttttttttttttccttcagcattttagataggtcatgccactctctcctggtgtgtaaggtcaagactttaagtctgctgccagatgtattggtgctcctttgtatgttgtttctttttttcttgctgcctttatgatcctttctttatttttgatgtttgggagtttgcttattaaatctcctgagttagtcttatttgggttaagtctgcttgtgttctataaccttgttgtacttaaatattgatatatttctataggtttggaaagttctctgttatttttttcaatacgctttctaccccaatctctctttctgtctcctatttaaggccaataactcttagattttcccttttcatgctattttataaatcttgtaggcatgcttcattttttttgttattgctttcctctgtctgtgtgttttcaaatagcctgttcaagcacacaaatcctttcttctccttcatccattctgctcttgagagactctgatgcatttttctgtttgtcagttaatagggctgttccagaatttctgcttgagtttttaagattattttaatctctttgttaaaattatctgatggaattctgaatttcttctctgtaatgtcctgaatttcattgcgtttcttcaaaacagctattttgagttatctgaaaggtcacatatctctgtcactctgggattgctcattggtgccttatttagtttggcaaagtcatgttttcctagatggtcttaatacttttggatgtttgtcaatgtctggacattgaaaaactagtttattctaatcattgcagtctgagcttatttatacctataattcttgatagggctttccaggtatttaaagggaattgaatgttgttctaaatctttggtcactgtgtgcattagggggcaccccaagcccagtaacactttaagtcttgctgactcatacaggtgccaccttggtgatcttcagtaagatacaagagaattcccagtattagcaggtaaagtcttgttctctttacttactttctcccaagcagtgtctctatgtctcttcgtactgagctgcctgaagttggagaaggggtgtcacaagccctcctgtgactaccattgctgggactcttcttggtcacagctgaggctagcacagtactgggtcctgcccaaggcctatggtgactagtgtctggctatggctgctgtatattcaatgctcaagggctctttagtcagaggtactgaatcctgccacgcctaggtctttcatttcagggccgcaggttcccttctggcccagggtgagtctagaaatgtcatctgggagctatgtcctagtattggggtctttatggattagatttgtgctttattgtactacggctgagctgttaccgaagttgcaagacaaagttctctttactcttctctctcttttcctcaagctggaggaattctcccagaattgtgagctgtgttgccagagttgggggagggatgacactccctttgctgctccagctggtttcttactgagttacatgcaccccaagtccactggctccaagcccagcaaagcaccaagactgcccaggaattacagtccttgtggtctaggcagcctttctagtttatttaggatctcagggcaatttaactcatggtggtggtgctagccatggctcaggttcttactcctcagatgtgctatttccctttgactagggctggtctaaatccttcctccttggaggctggctgaattctgccttgcattactttcccctgtgacaagtcagaactgagttataatgtgaagtctcaaaatcaatgcactctccttctaccaagcatacagattctctgtcctactgccttgtgatgaactgggggatgggggaggggtggtgtacgcaagtaaagactgtctttcctaccttctttcatacctatttccttgatatgaggttaaaggcatacactgtaattgctagcttgatttttggttatgaagatgctttcttatgtagacagttgttcaatttggtgttcctgcaaggggaacaattgctggatgcttctcttcagccatcttgtttctcctcctaccaaatgaataattaagaagaataaatggcacagccattatttacctaattctcaaatttatcttattattatcttatcttataagaaatttattgtgaccatagcctttcaggattgtttgactattctgtggtagtttttgttttctttacttaagtaaaaacttcattttcttcagaagataaaagactattcggccttcagttttgtagacaaccatgagactaaaaaactgttcttaaggaacataatgtctgcacaacaaaacctctagttatcaagcctcttcctgactggcagatatgaagttagaagatgttggtagtggtgctttgaagatcctccaaagaaacctgtttgcagcccatacatattgtcagattatttcctaagaactgaagaaatggattgtcaaataactgttgaagatccaggtccaaaagcctgtcacataagtattaatggaattttaaattaattaatgcattatatattaataatatatttttgattagataatgagagaatatatgacctttgcaagaaaattgaatttagtcttggatagctacaacagctgtaatagaaacagatactctccataatggggcaagggagcaagaacttatccccttccccttattttcaattaattacatttcagctctccactaatttattctaatatgacctcgatatcactggtttttgaatcaaacttatgccgcacattaaaaaaagtcttacaattcaacaacaaaagatggttgcattttgttttataaaccaccaatcttgttacattaggaaagctctatcgggcagctttatttctggggtactacttcatagtatatttattgatgttttcttttctcctcctcctcctctctgtcctcctccttcactgaatttctcttgctctcagtataactaaaaattagatttttttttattctacaaagagtaggcagaagtagtcaaacctagtgctcaaaatagtatagttattgattattccatcttctggaaaatgtgacctttttgtttttgtaaaagttactaacaaaaccattaaaaatcttgttaaggaaaccttaattttctgagtattttcttacccatacctgaatattgaggcaaattgaagatgataatcccctttttcatttcattttagataattttctatgaataattcaatgagcactttcatttgacttttaatttctttcatagtccccaggaatattacaacatttttctttacgtttgagaaaagaagaaaaatacctattatgattgctaagaaaaaggaaaattattttccttgaaagtaaagtggatattgttgacctttaattcactatgcagttattcacaaattgtttgtagtaagctggtaaagtacaggataagatatggatcctaccttgggattcaatggaacagagaaacagggcagcaaggatgtgtgctgagtcacagaataaccttaccacctgctgccactgccttagtccaagctgccatgtctcctcacttgtattattctaactgttcttgctgcctctcctggattctggcagtgtattctgaatacagcaaccagagtaaaacttctaaattaggccagtcatgttatttagcttcttagaggcctctggtttatatctttgatctctcacaagaatctcactaaactccattaggatagagaacttgatgtgattggtcactactatatctccagttcttgggagagagaatgcttgatgtgtaggaactatttcttcatatttttgaattaatgatattctggaagcatgatgtctcaaagatagaaatttgagcaccctctgtcactcttcagaaggtgattggaagtgtggaaggagaccctagatcagtgactcagtgaagcaaagaatgtcaacttcatccttctagagaaatgtccaaaatgtatgctaactggagacattaagagacatatgacaccaacatgctgagtgatttatcagagcattggcaaggtacagaatttaccccatatgattcaaatgaagatggttctacgaaaggaatgcatgtggtatgtgatcaggattaaaggagcagaagcagcaggaaaccattaatacccactagggctgaaggaacaaggagagaaaacagtattgtgtgaccagtgagatatggaactgtaggccacatggctcacacctgtaatcctagcactttgggaggccgaggtatgtaaaacacttgaagtcaggagttcgagaccagcctggccaacatggtgatatcccatatctactaaaaatacaaaaattagcctggcatgggagcacatgctggtaatctcatgtatttgggaagctgaggcaggaggattgcttgaacctgggaggcagaggttggagtgagccgagactgtgccactgcactccagcctgggtgacaaagcacgactccacctaaaaaaaaaaaaaaaaagagagagagagaaggaaaaaaaaagaagatatggaactgtaaaagagggaccaaccagtaggaattctcatcagagagggatgcagtttttaccacagagagggatgcagctctgagacaggggaggggaaggaaataccctgaattctctcttctacattgccatcccctattgccttccattaacccagctggatgccagacaggaagggatctcaactgctaccctctgcatgagtttgccttcttgggctcagagcagggcagagaattgtcgagagactggatcttgagcgggtgagaatagagaggcacaggagatatcaccatgggatataatcatgcctctgattttctcactgatcagaccacacctagagcactgtgctcaattctggccattaccttctaacatggtcattgacaaacaaacctatttaataccaatgatcatgaacagatactgtaggaactggggttattaagcttgaggatagatgatttaaggattatgcataactggctacataatttgcaaggcccactgcaaaataaaaatcagggagcatttgttcaaaagttattaagaatattaaaatagcaacagggaggattgaatcaagcatattgctactcaaatttgcaatcccaagttccatgctcatgtatgtagacctgggaacatgtcagcctccatcaggcatttaagggactggcatgaggacaacaggtcaataggtaaagaatagtctgtgtcttaagagagtaaaactcacatccaaggaatggaattttatcaagtgcttttgtttgtttgttttaaaataagttcagctgtttcataatggaatatagtttctattactggaaaatctttaagagatactatagaaagattgaacattaacaaggatgttggacaaaatgactattatggatgctttcaactctgaagatggagaaatctgacattttttaaaaacttatgaactgagatattattcttcattatggacaggttagcctgagccctcccccctcccaccaacacatacacatgcatgcatatacatacacagtatataatgatctccatggcaaaagtgtgacaatgcagagaaagagagagcaaatcaaatgcatagagggcaaatgcaagcctttacctgtgcactttaggaagccaagaccagatgagagccttgttttctagtctaatgttatttccatgaaatatgagagaataaagttccttaggataagtcagcccctttaagaaagtaacaaacatcaatttgtttgatggcagtaaattgaaaaatgttgcattatcattattttagttataccaaagtatgtacatttttaaaaatgtattatcttgatgcggaatacctattgaaaaataacaatgttatttttgaagcaatactcctgcttcacaatctcaatttttgaatgctctaatactcttcatttggtcattttaggaagttatacagatacacgttcctctgaacttcgccaatacttacagtattgtacaatacttatttgtgacttctcatcaacaccccaactggttagatgctgttatttttactggttgtatattaagacaataaataatttcgtacttgggtagcaaagaattgttactgactagttcatatttctaggttccccaccaccatttccaaaagagggactttttcttcttcccaaataaaactgtgcacagatgccaaatgcataaggcaaatgaaagtaaaaccactgtatttaaagtaagcacagtgagcacagagccctactaatttacttccccctcatctccaattttagcttctgaggcaacacaatgtgtaaaccagtgatctggttcaacttgctcaatttacgaataaggaaacatagcctaaagaggtttagtgacatattcaaagtcaaacagcttattagaagtagagccaggataaaaacaaagtctgtgaaccctaatgctgttttctatacactatgctacctgggtggtacacgaattaaatatactacccatcatatggatagaaaggtgtttagagtattccaacagtgagggaaagtgtcactgttgagtacaaaaaatctatatgctttctcatttgtttgttttaatttgttaaatttgtttaatttgttagcttatttaattattcatttttcacaggaaatgaacaggaaacacaggatagatgaataaatagaaaatgataaagatacagacaccacacaagctatgcaattacagttctgtgtaggcgaaggacttgttaaaaatgaatctgttctcttatgagtgcccagagactccaactagttatccttctgcctggagcagagctttatatacagtggggactagtccctttttttattgtttttagatgttctatggtaaatatttaatctttttcatcttttgggaacacgtgacttgcatggaaaaatcaagaagtgactaggaaaaaatatattcttatttacaaagcaacattttttttccaaacatgactggacgcattcgcttgttattttagagcatttcaataaaagatttaaaccttaaaattcaggagaactttggatttgtttttgttcccattctctagctactgaaaagggatagagaccagcaattttaaaatatttcttggattttgggttgcatattttaggactttatctgaaacaaaaaaaaatacgttctacattgtgtgtttttaagtattgagcccatttctatggctatatattgacgtgaatagacatttcacctactggattcttgcttgaaatacattttaaatgtatggtttatcatgttcttgcttaaaagtgctgctgattcaaaccatataggatattcctctttgtctaaccatttgacaatcttagacatatatagtctaaacatatatgtttgagaattgttcaggtttttgtctaattcactccctcttcacagcctcagctaaagaaagaaagccaatcaaaactatacccatcacaatgtaaaatgatgtaactgctgtggaaaccatttggtggttccacaaacagttaaatgtagagtttacatatgaaacaaaaattccactcctaggtatttgagaactcctaggttctcaaagaagtattgagaacagaaactcaaacaaatatttgcatatcaatgttcataaaaacattacttatgatagccaaataaacttggtgttcatcagtagataaatagatgaacaaaatgttgtcctgtatattcatacaatggcatatttagccttaagaaggaatgaagtctgatacatgccacaacacggataaaccctgaaaacactagactgaaaaaataaactagatacaagaagacaaatattgtatgatttcaattatatgaaatatctggaatagatacgttgatggaggtagaaagtagagtaaagactaccagggactggggaagtgggaactggggagtgattgcttagtggggatggagtttccatctgaggtgaagtgattttggaaatagtgctgatagttacttagcactgtgaatatgtatgatgccactgaattttacccttaaaatggttcagatggaaaagttgattatatgtattttaccataatttaaaaaagtatatactcataatctctagaggaaaaacacaagtagcaggaaaaatcgtatttgtccccaaaatgactattattgcagtaggtgggcttcatgttccagagctttgggcactaatattagatgagaatgaatttgttattattgtgtttctcatttgtgctagacactgctatggtaactggggttatagagatgagtaagaaaggcacaccctctgcatcttggagataccagtgaggatggccaagaaacaacaagcaaacatagaaataagcaaatttaagttataagtgccatcacggaaacaagctagagatgaaaatagaaaatgtgtgtgtgtgtgtgtgtgtgtgtgtgtgtactggtgaggatgaagagtttgggaacatcctgctttattaaaaagaagcatgagattcagagtgaaaaaaaaaaaagtagacaaaaattcagaaaaaaaagggatggcagtgtagtctggccattgatttacctggcagtggaaagtagaaaagaataatatgaacgagtctggagacactttttaccttagacaccagccactttgagcgaggaagtatatgagtaagaacaggatggcaattttgctaatatactacatgtacgataagttttagattgctgttaaatgttgtttggctagagaaacccaagattaatagaaccatgctttataaatcatctatttcccacaaggtttccaaggcaataatatactcaaggaacaaggacaaatgagaaatgtaagttccactttaattttagttggggcattgcctgtaactgccaattaaacgttttgaaaaatctggattcaagtacaatatataaatttggactcaacgtctccaagaaaggacttcggcctcaaagtccaagtcttaccactaacaggctgccaagttcaaagtgattagggtttctgaccatcagagtactaatataaggcaactaagaatgctagaataacgggtttccttgcagtatggagagaagggaccaccatatgcatataggtaaactcacactttgtaaatgtgactcattcactgggcattctgaaatctgaacaaacagtttaatatctgcttttggtgaagttttaggttgaactgagatattaaaaggattttcacagtcgaataatgaggaaatcataattcatgtcagtcagagagagaaaatgaccccaaacttgaagactgtattccaatatacctagaaaatgagatactttgttaaaataaggtataataggataagaagctgaaaacagaacttaaggccatactactttttaaaacaggcaaaaaatagcctcttatttttatgctttgagcagtcatttttaagcttgtggaaagatagttaccgaatctgggtttagaaagatatattctgggggctatatgtgaaagaggtggtgcagaggaaagaaactcctagcagggatggtagtaagcatgcagtcactacttaccaaacccaagatgatcatttttattcatattactagaaaagagactaacaaattttttccatcatgtaagaaaatatggtgaattatgaccattattttcaaaatatatcatgcgatcatagatttttaggagcaatacctcctattacagttcctaggtagaagacaggggagagtaggtttgcaagatggacaaagttgacaagtattttcatggcacatataattttctcaaatatggaaaacatgatgtttgtatggaatgctaaaatatggataagtatagataagaaatattgcctcatattttccctcattttaataaccatagtcaatattttagggcatattcccatgttttctgtggaattgttttataaccactttctccaaaattgacttatgctgcatttagtctcctcagataatattttttctaatcatggtgggattacacgcaaattatataaattacatacaacagacagaaaaaattgtttttaaagctaccatttatgtgcatcaccactgccaaattttctgctatgagattctataaatatatatatgagaataaacaattttatttaaatctttaataattctgaggaacatttctgaattactagttttcaaattaaaacactgaggcatagagaagttaaatgacttgaccagctagtaaacaacaaacctgggatctaatcctgcttgattccaaagctctggtgttcacgattaagttattctgctctcccaccttgtaaatggtaaaaccctaaacaaatgttccatgtaattataataatttctaatattcgcatgagtaaatactgctgcagagcaattgtgacattttaaagtcatacaaatatttagtgagaagatagagcactagaagccttccaaactctgctctgttttgataaaatagcattttgttctattttcagaattctctctctcttagtcttattctctcagtcttgctctcagtttctatgtccttgtgtggcactactagcagttttggacagagtgggggcatggaaggcaagaggaggagactcctgtggtccctctgtgggacactagagtgtggccagctgtggcctcccagctgttggaaggctttcaggaaaactcagtgatgatcactactagctaacatccacagggctgacataacattccagacaagcctctaagtactttacaagtagtaatttatttttcataaccatcctcattatatagatgaggacatgtggccctgaaaagtcaaataatctacccaaggtgtcacttcaggcaaatagaacaccgagaaattgaacttgggtatctgcttccaggccaggattctttccctgttagccaaactgcctcaaatcctcaaaggaactctttttaactgcttcgaatagctaggcaaaatataacctgttactagcagtactagatgttcaaactagtaattatttagtatttaaaaaattgataatggtaattgactaactccttaattagccttttctggcgtggattccttagcactttcaaatgtggcattatgttttaattcatataatggctcaatggagtttccattatttactcaatttttagcagatgaatatgatgttagtaagattaagtgacttgcacaaggttacatagctcatatttactaaaactcaaaatttatgccttattttccaactctctgttgagtattgcattcattacaccataactgtggttatttctgacacagagaatttcctatattttgacatatatgtattttccaaaaccttaccaacatctatttatcatagaaatgtaagtttactcctgtctagaaagtaaaatagaaatgaaacaaatgaaaacagacaaaaataatccagggcttttgaacttttttttttctcccagatgaagtaattacttctacaatggtacaaatatttaagtaagccatctggtgagataatctcatgaaaataactctcagatttatgtacgaatgtcctcaaaatttggggagggctaataaagtaataatctatgtcttacatcctagaaaaatcacttgaggaacactcttgttttagttgccctctgttgtgagtctttcatcaaaatagaccaatataagtgctgaaaactccccagtgacagaaacgagagtagatgaaattaagaagccagtaaccataaatgcttttgatttacttgtcaataaatatcaatggttttatctggctaagagagacactgtaaaattaatttgcgtttacaaaacagaaggtaaccaatataactcagctttctcttctgttatacactaagtaaatttaagggtacttaaataaatttgaatataattttaaagtccttaacagttttcagatcttgtcctttatttgttctgacttcccctcctgttttattctctaaaatattaaagtataataagatttgaatgtagagaatgcatatgtttctcttccttgtcccccaccactgcctcctgccttgccacactccagggttgatgttctctagagtcagagacttttattttgttcatttgctcatctcagtgtctggcatttagtaggagactcagaaatgcctttcaaaatgagctttgcagagagactgaaagagactcaaagtcaggtatcactaagaccatcctccaggtgaaccaatctaataagaggtcctaccccgtttaataaagtaaccttgtccaggcatggtggctcatgcatgtaatcccaacactttgggaggccgaggcagacagattacttgaggtcaggaattccagaccagcctgacaaacctggcgaaaccccgtctctactaaaaatacaaaaattagccaggtgtaatggtgggcacccataattccagctactcgggaggctgacacgagaatcacttgaacccgggaggcagaggctgcagtgagctgaaattgcaccactgcactccagtctgggtgacagagcaagactccgtctcaaaataagtaaatgaataaatgaatgaattaatgaataaataaataataaagtaacctcttgtccacacgggcatatcttttgctctttggcaggctcctgctttccgacccctcatcaatatggccctatcgttgggaacatgtactcagagatgttaatttccacattcttccctacctcacgatcttctctccagtgagagtgacttatctgtaagggtaatattctttacttacaaagtttctgaaagataaacacatatattatatagacacatctgaactgaatcttctgattggatgaagatgtatgacacattcatgccccaaattaaattcacaattcagcagcataatcatatatcaataagaaataaaacaactattgactaggtaataagagcttctgtttatgagatcttttatattaacataataatcttagatggttaacaaataatgcagcctgatagttctcctttccaatacacatttttccaataaatacctctgcggtgaattgaatggtattccctacaatgataagtacacattctaactgtgtaaacctgtgaatatgaccttatttgaaagcactatatacacaatatatacatatattctagagataaaatgcattgtgtgtaatacatgcacatataggatggaatatgtatataatggttatgtaagatacacattgtatctgtaggtttacatgagtaatttgaataccacacttatggttcagagactcctgggattccaccgaaaaagaaaagggagtgtacaagctaaagctatttccagtgtttaaaagaaactaagggatacaatatattaattgcaataaggcagtacaggttgatggaaatcataggttcatttgctcttggctagaatggtgactccaggagaggatgacattggtttgctgtcacccattggaagttgagattgaggttacttatggctttgaaaaaatatgatggcatgaattaattataaataaattatcttcggttgagaaaatgtttttaaagtatgggctcctgaaggaaaataaatagtcaaaagagctgtaggcaatgaaagcttgacaagtggacccatatatgtacacatacaaattgacaattatgcataaatcacaatgcctttgtcttaattttctcttttgtgaggtcagtctagttttacttcttaacacctcatttgtcaactctctgcccttccccgaatgttatctttttaatgcatcctcttcatcagttggctactatacccttacttatctgaatctatctcgagaccctttaatcatttatttcattctcaatgagagcatcttcaattcgtttcataatgctattccaaaccctgaaattccttccatctcactcagcatgaaatctatagtttttacttggccaacaatccctaaaaatctgtcacatcttttttaataaatatatggaatgcaagtataattttgttatatccctaaattgcacagcggtaaagtcagatcttttagggtgttcatcacccaaataatgtacgttgtacctattaagtaattgctcataatctgtgctcctctccactactcaatcttcctaatctctattatccatcattacacattctacattcatgcaaacatgttattttagttcctacttgtaagtgagaatgttgaatttgtatttctgtgtctgatttgttttacttaagataatggcctcctgttccatcctcattgctgcaaaagacatgatttgttctttttaatggctgaatagtattccattgtgtatatatgccacattttctttatccaatcatctcttgatagacacttaggttgattccatattgtttctattgtgaataatgctgtgataaacatatgcgagcaggcatctttgtggtataatgaattcttttcccttgggcagatagccagtagtgggattgctgaatcaaatggtaattctatttttagctctttgagaaatctccatactgttttccatagcagttgtactagtttaaaaatgtgtcacactttgatgctcaccctcttctcctaacattctccctcttaaacatcctctcatatctcctcttctaccaaatcagtcctttctcttgcttttctttgatgatgacagaaaccctctagcctcagggccttcgcatttgcttcgcccctgccccaacccacagaattacagatctatccctcttttcactcaggtgcacgaataaatattatcataaacaggagtctatctctggctaccttatctaaagtaacatttcccctgctgttgcttgtcctcttactctgctttcttttctttccttttctttgctttttttttttttttttttttttttttttgagatggagtcttggtctgtcgcccaggctggagtgcagtggcacgatctcggctaactgcaacctccgcctcctggattcaagcgattcttctgcctcaacctccctagtagctggtaccacaggcgcataccaccatgcctggctaatttttgtatttttagtagagacagggtttcacattggccaggctggcctggaaatccagacctcatgatccgcctgcttcggcctcccaaagtgctgagattacaggcgtgaactactgcacccggcctctctgctttattttcacgcatatttatttttctgtttggtgtctttctccctttgagagaatgtaagctctagaaaaaccagggagcaacttggatgtgctctctgctacccttccaggtcttagaaatgggtctagcaccaataaatattttctgaatgaataagtacattcattttcttactcttcatttaacatttgagtacctaataacaatataatggtttttgaatactcagtatgtgctagataccatgccaagtgctttacatggaccacttaatcctcacaaaagccttttgaagtaagttgttggatcttctcttcccagatagaatgtgagtctgggggaaatttttaaatgttcccaagtccacatgactattaagtagcaaaggtaagatttaaacctagacatcctaactacagatcccaagttcttccaccctaagttatactggcattgcatcaggttcaaaagataaactcattaaaaaaacaaacaaacaaaaaaaaaacaaaaaaacttttctctgcccttaggcagtctgcagcctaagccagaaagagaaaagcagcatataaagttaacacacggcattttgggaccttctcaggggatcgtctaaaccataaagaataaagagaatttagccatgctaagaaatgtagaaaaggatggcaaccacgccctgaaatgggaactacttgtataattccagagttatggaaaaacctcgctcaactatggaacttattttggctgtttgcctaagagatgggaaaacaaagttgaagcatttggctttttagccctaagtttgagatgcattcggaaaaggtatcgtcaaaaatgttaagtaattaaaaataaacaactcagaagaaatgaaaagaaaatatcagaggctatgggaagacttctgttgagagcaatcaagcaaatgatcacttttcaaaggacaaggagtggataggcctccctcctaaactgaggaatattgctgaaaagttaatgtgaagacttggtggcaaaattccctggcactttcagagctcattcaccataatgcacaaacatgaaggggcatagcctaggtctttgatttccctagctctgctgtgttgccatcacagcaattagggaaacattccaagatacttctggggtcaaagaacatgaaggctggaaacgacttcagggaatgtctaagagattagagtcagaaagaactaggttggaattctacctcaggtctttcctaacattgaaattgtatatagcttacaattatctcagatttatctaatataaaaagagaaagaaggatatcaactttataggattgttgtgagaactaagtgaattaatgtatgtcaagggatataacaacatcaaagtcaatcaatagatattagctatgattttattattattatccaccccaaaccattatttttccattgataaggaaaccgacataccagaaaatgacttgactaagctcacacacggatctcacaagttacccaatccatcagcattcctctagggctctccctacctgtccacgtcaggtaatatgtttaagttccattaaagatctgataactggcctaaaagttctgtcttattttaagcctctgtttactatccccacaaaatcatggacctgctttacctttaacaaaatttacagagatcacttcaaatatgggatcgaagttgtagttggcaatactaggaataactgtaaagtgacagagcctgcatttcataaggtggttttgacaacatcattttcccagaaaaccatcccaaacaagactgggctaaatggctcttctctgtactgcgggacagatgcttacctctatcttagtatttattattttatctactggaattatccatttggtggccctttttataatttaaaaatagaaactaagtcctagccatctgtgtaactcctgttcatagcacaatgtctaatatacagtagatgatctctaaaattttatataattgaatatttattacaattaatatgagttccatacagaaggccattataccatgttttaatagcatcagtataattatgactgtgtagatttagatattcaaaatgatcattttaaccaacatgcttttaggtatataatattttcagttttagttaaaaattcacatagattctttgcttttgtatctgttaaaatagtcatccactttatatatctatatgtaagcagtgctgtgtttcagtttgtcacactgactttcaagagttgtgtccatctcttcccaaatctgtgttcagtgatttcacatttgtggcttgaaactggtcatgataggagtgcttgtgccatggaaatcaactaatgttagaaagcagagattttttcttcctcagaaaccaggttgttatacatttaccagtacatcactatacatatagtttttaatactatccactctagtctgtgtagttctgcatttatggtttttatcaatctacggtagaagctacatctaattttctgtctctgcttcattttttatgccacctgggtacccataaataattaccagcagagttgtttatatatttagcagacactcataaaataaataattaatatgagacggtctccatatctaactagttattcctaatatatcttttaaagtcttcttacattttattaaatgaagttgggaggatcagctttgtgagtgaatcaaactcaaatttcggtggactggacaaaaatatattgtggaactagaaaacaatgtcttaccaaaattgcatataaatttaatcagctgacaaagcttttgcactgccttatttatacaaagaaatgtggaaataaggcagttattcagacttttcttaaaagatgtaaagctgagattgttttacacacataaatgaggtgtgggcttattcccacttcagatttttttttcaggataatacaagattatttcaggccattctagtattataaataattggttctggctcctaaatggagcttaaatttcaaactgtaggttattattataaagtaatctttggtggtaaatcagtccatttcctctgtagttacttaagggtggaaatattcaagaacatggatatattttaaaattactgttctcagttctttccctcataaataattagtaagtctactaattattttcttccagaattatccacttcctaattatccactatttttttcttccaaatacagtaaatgggcaagaaataagttttattttaaaatggttatattactctcctatctcagggtatatgagataaaatttaacagagattgatggacgtctaaattttagccagcttatttactgatgagacttctccctataccctctgcttgatggaatgttcatgttgctcaagatgaaataacctaagacagcaataaattattttggcagatattctgaaagaaagctcctgggaaactgctgtagatgtcattaggattttaaaaatctaagtttgtaggctagtcaaaaaaatctaaagatcacaatcggaaacctaggaaactgacaagtaacaataatgagaatgtacacaaacacataccaaaagcaaaatacgtatatccctttgattcgttcgaataccacctaaactctgacccactaagagaaattcaggtataaagggcatttttggtaagctgtagtcatgttcatccatccatttttccatttagtcctttacttgataagtaaattattaattagtaaacaaagttaggtatcaatctaaaaattactgcaacagtttctaatatcaaagtagtagcaagccagatagataaatagatatatagttcaaatataatgtaacgaatgaaaagaaaaatacatcatgttttgtgtgaacaccaaagagacataaatacctgggagaaaagggaaagttttatacatacacatacacaaatctgtgtgtttatgtgtgtgtgtgtgtgtatatatgacacatatgactggataacagggtgaccgtatatatatttgagcacctgtgatacagcagctgctatactagttggttttccatagtttatttcttagtccatttattttaatctttcaattaatgctacagacagtcagtattatttgcatttttcatataaggaaactgaagttttgggaaattaagcaaactggtgttttggttgaattatgttcccgcctccaaaaaagggatgtgaaagtccaaatgcccattactacagaatgtgaccttatttttaatagggcctttacagagtcaatcaagttaaacatattctgagttaaacattattattaattattattattaatcgagttaaacattactagtgtgggcccttattcaatataactggtttccttacaaaagagggaaatttggatacagagacagacatacacagagagaaggtcatgtgaagatggaggattggagtgatgcatccataggccaaggaacaccaaagattgctgtcaaaccctcagaagctggaaagaggcaaggaagaatttccctacaagttttagagggagcatggtcctgcaacttgttcttctagcctccagaactgtgagacagtatttctgttgttctaaggcacctgttttattgtattttgttatagcgcccaaggaaacaaagttggtcaaacatggggctagtaagtagtgatgcacaatcatcctttcctggttccaaagcttacatgttttctcctttacaaagaaaattatcttcaccaaaaccttttaaggatgaattaaagcttataaggtggaagggaaaggaaagtgccttttatcggaaaattttgtgagttcaggctaactctaaaggccctcaaccttagcagtattgacagtttgaactgaatatacatatattttcaggtggtctttcctatgcattgtagaatgtttgacatcatctctgacctcaacctactagatgtcagcagcacctctttcagctaagacagtaaaaaatgtccccaattaccaaatgtccctcaggaggcaaaaatgatcctgcagagaacgactaccatcagtaacttgctgatgttcacccagcaacagtattgcaagcaaatttatttcatgcatcttacctgattaagagtagttgcccaaaacatggtattaagaaggaataatagactttttgcaaattaaagaaaaaacgtttcattatgaattttttgtgtctgctgtgggcccaggaggggaaatattgggctgtcctttataaattctgacttctagctagtagtgctagacagaagaaaagggatgaaccctatgaatatttatatcaaaattttaagtttggtgaatgtcagtttatccaactgcctattttttcttgcctgttaagagtttcagaggagtttgaatttccttttgcagttcctcaactttgtcttttttagaaggttgatttcttccagacatacggttattattaaggaataattttttaggtttagccatccatgattgaactgatgattcatcctgtgtttcagaacactagttgggcagttcgtttgattagggtattttgtcctggagttcagggtctgtgatgttgccctaaaaggatctgcaagctcagacatttaacaaattttgcactttatgatggttaattttatgtgtcaacttgactggattgcagggtgctcagacatttggctgaatattgtttttggttatatctctgaggttgtttctggagattagtctaagaatcaggctaatctccagaaacagttgaatcagtagtctaagaaaagcagactgactttcccaatgtatgtggccatcatctaatcttttatgatgtccaatagaacaaaagataggaagggaggattcactctctctgtttgatttgggacaccattctttctattttctcagactaggactcacatcattggccctctggtcctcagaactgcaccactggtcttcttcagtctcaagcttgcagattatgggatttttttgcttccataattgtgtaagcaaatgccttacaataaataaacctctctatattaatagatagacaagatagataatagattctcctattgcttctgattctctgttgaaccctaaaatactctcatttcccactctgccccatctcaactcttgtttttgatacttgctattgttttatttcctcctttttttcgtatccctttctacatatcttcctttggaaatctttgttgttatcttcttatttatgatacgatgcctttcccttttggaatgttcaggaaagtttgaaatgcttctctgataattgccttatttatgtatgtcagtgattagatgcacaagtgttggaaacaggcaagcttagatttgagccttggcctaccctctactagatgtagttacctcatcaaattcattaaattcatctatgaaatggagtagttattgtgtaagtgatatgtttgttgcaaaactttcaatacatattaccttctctctaataggcagttaataatacaatttgaaatgccttgtccatttctttgcctggagaacctccttcaaaattctaatttcatcctaatgttacttttctcaattctagtgctgtttcttctaaaatattataaaaactaatgttttttactagtaaacatacgtttttaaacttctacatcacaagcacctaacatagtgactaacacttagaaggtgcaataaacatttgttgaattacatttgatcacacagaccttaattctataatagatgtgacaggcatattattgcacagtgtatgtcaataagcagcaaatgttttcatagaaaaaccaatttaaaatagttcacatattgacattattgtttaaaagtagcatagatgttaagaaaccaagtgataattatatggtggacttgtttttttccatttttgcctttacaaataatcagattagcttgtggggaaaaataatgaataccaatagtaataaattcttcagagtttataaatattttcacaatccaattatgatagttaatactcatcgttgattgtgcaaaatttttactatattattcaattataatggtttaagatatgatcatggttattgttccctctttacagttaaagagacagcctaaggtttagtgatgcacttgaagtcacaaagctacaagttgaggttaaaaattccaacttgtctactgccaaacttatattcatcattctttatagcctaactaggatgtagggttacctccactttactgatgaggaaactatttcaaaaagattgtaattatttaattatgtgttacaaatcactttcccccatccaaaacaattgaattctacaatgaaaaatcagctcagtctttttttaattagtttacttttttagttattttcttaattgtttcaatagggtttacaatatatatctcaatttatcagtctgcttcaaatttacactaacttaattccagtaatatgtatattttaatccagagttaccactgttgtctactctcttagtcagttcaggctactataacaaaaatagcaccaggtggcttcaaaaacagatattattttttctcacaggctggaggctgggaagtccaagatcaaggtggcagcaaatctgttgtttggaaaggcttcacttcctggtttgttgatgacaatcttcacattgtattctcatgttggggagagcagagagagaaaaaatgtgttctttcatttctgtttttatgagggtactaattcattcataaggattctgtcttcattacctaatattgtccccaaatccccgtttcttaatactctcactttggggataggattttaacatatgattttttgaggagaaccaaacaggaataggaacaaacaagcagtgaagataaaaccgattctgccattaagttccaagttcaagcacacagccagaaaaaagttctgaaattctgaagattagtgcctgggaggcactagaacacaggttagaaaattgcagtggtgggaacaaagagaaagtaccttagtgccataggcagacctcaagatgaagcagctacattgtctgtggtataaacccagggtttgttgtcaatcgccaggaaaatttaggacacggacaaacacaagcagtacaggagctgaggtttaataggcagaagagaagagaaagataaacagctttctttatagagaaaggggtttctgagcagaagggactggctgacagcaaatgcaccaaattttgtagtccagtttgaggtggcagtgtctgatttacacagggcttatagattggttcgatcatgtatgatgtttacataatgcacagggaagtctggtctccccaccctaatgttattatgcaaatgggctgtccagttgatcagcaccatcttgtctgctccttagagtacacatagctaacagagaagagaagatggagccaccatcttgaaaatgtctagtgcttagtttctgccagcattcacctatgcaaactcccagcttgcttgtctatgtctgcaggtcaactttacaggctactctttgttagtaaatgatttggggctgtgtttcattaaaaagaaaagcattaccaaagactgttacacccttgctatctgcctaagtgatttcttcttaactcctctatcattcccctctctggagtggtaaccctaactgcagttaaggggtgttggatgatgactctttctggctacttcctgctgaaaagggacgtcatgtggggaacagcagctagggctcctcttggttcgatctaagggttcctggaagaaagatgcatccatgtgttgttcagtctaaagctccatttggagtttaattgctgtcagtcattccaatgggttgtgatactggttttcctccaccaggtgctgctgaaatattaatatacaagtaacattcttttttgaataagtggtattggatttgggtagctagagtaactttagtgttaaccttggctaaatctttcctgtaagtattaattccctcattacttcaacagaccatctaagacgtgcttaaacttgtcctaacatccttctttttaaacgaccaactattctttttaggacaggtatttaccatccttgtaatcttttcatgacttccacaaccatctataacatgctcaaatcttctgacttctcctaaacatccctcttttaaacaaccaactgttctctttaggagaagtatttatcatacaagatcctttcttatgtaaaatattttttcctttataacctttgtatatagccagggtgtgacattaccaaacccaataagaagttctagcagattcagtgatagtaaaactttcatacttcttttttcttttctttttttttttttggtgactattatccctcctgtaaggataataattaagcaaaatactacagcagtggaaactctctgtctgatattccagttagaaggtgctactgtgtatagccctactgtgaatagtagagggagtatagcaatttctgcaagtgtggtgtagtagataattttcatctaaagttttacctgccaagatacagaatttccctttggggagtctatgaagtttcttggctttattttcccaaacaaataaacctctgggttatgggcaccctactcactttcattacctggcagaatttgcagaataattgcccagaactagcatatttatccagattttcacattacccatctctctttgtttcttccaagctgcaggagatcaccacttgattcacagaaataagcagggttagtctaaaatgtaggtaaaaagcttaaaaacaattattgtgactaggatttaatgacaaatgtatgataagctttggagcacaatttctctctccattgctcatttttggtaaaaacaaattatgataggactgtgttctttgtagaataaactttagccttatacttggcgtgaatatttgcataaagtgcagcaagaataattatccctacataggccttttgggttggctttgatggaactctgttccataaggaatctcagataatacctcttcaagccaagttcagcaatgggtttttatccccaaatactttacacttaaggtcccaagataaacttggaggtcctggacaagttaaaaagtgacattctttactgactacagactaagaaacctgtccagggactgtgtagacaaggtatgaggccagtcttccccaaggtgcttttatcagctctgcaagctgagattgactctttaaagggggaagcatacacttcctgtcaaagctttgataaaataaccagtttttctaattgtgtcttattgaaaaaaaaaaaaagaagacttcttgtggcactgatgcaaacaactatattgccgtaagttaaggttactcacagatggtttccaaattctagaggaaccaggtacagagaaacaaacctgctccgaattttgttcacaagagtataacttacttaattattaaaggctgcacatagttcaaaataagtttccttgactctgaaaaacaaaataaggatcagcaatattctaagcaaaagtcaaaaagattgctttagctttctgagtacaatccatttaagtcaactcttgtttcacttgatattcataaacatttcagttcttcatgagtcctgtacattttttccaatgttacaatcttcaaagctattggaaatctgcatttgagaacagctgttaaagtcttatagcttgattatatcccatcttttgagaaggaacatagcaagataacaattgtctgtaagtgacaaaattttcagggtagttacagttaaaaacatgactgacaaagaagtttagttatctccgtggtttacaataattttaaaattaattatgattgatagcatatacttagacattagaattttagaaatcccatacaattttggaacatatattggtattattcacaaaaatataagttaagactggacatcattttggcaatcccaatgtgattaaacatgtcaaataatcctgttcacctattttctgaatgtttcaggggccccctgaacaatctagaaagccacgcatcaggaaagacaattttgaaacttgaagtttgattttggtatgtctgttaaatgttagaggtttaaaacagttgatgttatgaaatagaattccagatagtcataaattacttattttgccaaaatgatgactcaaaaggcaaaaacctttcataagcctttactattacataaaaatcctgctcaaagccaaattttacctttgcgttaatttattaatgttaaccccaatttgattaaatgccaccctaaagaaaattccatctaatcttaaccaatttgaccatgagatgaaatccttacaaaccctttttataacccattttgctaaagggcagattagtggcttaagacagccttacagtgcttttatttcaatgctcaatttatgaaaagaccatctttccacaacatgcttaaacctgtagctttatcttatcaaatttaagataattcctcatccctgggcaatatttatatttctatggtttcttataatcctttactaaaaaacacattttactgtttttatacaccttgcctttaaaactgttcagtgatctcaaatacatgctgcactgttaactcttagcaacttttacatttgttgagaaacctggttagtaagcaattttaattatgtaccaggcgtggagcctaggacccaggcagaaatgcatataagatctgactctttctagcatctaactccatgtgtcccaggccttacttatctgaaaatcaggaagtatacaacctttgaacatttagcaaacctagtatctgttttacgatttagaccacctatttggattttgatgacccttgcattttaccaataatccttaagattatttttatttcttaaaaattaaagtcacatgaactaaaacatatttgatttaagcactattttttaagccaattaattagagctcttattgtagacattacacacaacacatatatagcaacacaaacagaatattcagcacttgtaagagttttcatttgtcagtttcttaattggattactggcttcagggtggagcctttggtggaactgggccaggtagcatgcatttttagggcctaataagtaggcacagctgaaggcaaaggcagatccctaaaattaagtgtgccattttatactagatttttggtcccctaaaggagggagatactatgggagaaaacagtgcattgcttctaccatgtatttcattgtaaggcaacccaaagctaatcagctttatcccccatgggagtatcatctctcagtcgggggtggggatgtggggatgtggggatgtggggatgtttccatatctttcaggtggccaagagcatgcttctctgatttataactactatttgccatcccttaaagtgtatttcctgcctacttattacacatcaaagctctctcctaatgtgaagtattttgatacacccaaaactcaaaatggtcagaacacacaaagcaaaactgaacagaacctttaatttagagagggcactatctgctcttaattcctggggtttcatgaggaaaagaaagggttttttttgtttgtttgtttgcttttttccccacaatggggtctgtggcacctcctctgtttttcccaaggactaccagaagttatcttagggcctctcacacatgcattaagagtgtcaagaaataaaatggagaaagatgatttagtcaactgagaaaaataaaaatttttttccagaaaacaagatccaagaagagaaaaatataaaggccttttaaatatatttattacttgaatacccagttttaattaagctgagcactctttaacaaaatccctttaaatccactgttactcaactttagctatgccaagcagttaagattttcagcttctgaactttacaaaaagtaacctcacaggtgaaaccaacaagccttaattatgttacgatgtaacagtgagtgtacaaggtgtttttaaaggggtgataagcagcttttgaaactgtcattgcaaaattgtgactgagacagtgaaagagatctgacccaaagaactctattttttttcaagcctgcgagctgtccttgtccatccctgggtgtaggctgaaccaactttgggaggcacctggtttacagtttagactctaaaacaaagatgatatcagccctttcttaaaatatactttcctcttgcctgggtactagaccaagaaactagccacaagattaaaatccatggcttaggagtcacacagctggaggctacaagattttgaccacctcttaacttagccctcaagattagtgcttaagatattttgtaaaccctgcccttgatcaatcagctggcagctcccttattgacaaactggcttatctgattttgtggccattacccagaaactgacttagcataagaagtcagcaaacattgtaaaatggtggagactaaaacaaattattcgccacatggttacaggtcatgttcccaaggacaagaagcaagatggaggcctttagccaagtttgttactgatcattttgttgggctggcttgaacagcaggcttagggggtcctgggtctgcatcctaacctaaagtaacttttctttggacagaaccatacagaaagacacacaaagcacaccagattgtctacaacttaaggccaacctcacaaatcctttctcattaattaaaacttttcagaaaatataaatagtgatccttattatttcttttaccggtttgcacagggatagagaagccaaaaacccaactagtaaaaaaaaacttttacctttttgccggcatgtcatgcttctgggttttctttctcccccagctcaactgtaagccaagcattttaaggtttgggtaaattaacttctcccaggttgaatgaacatcataaaagggccattgaaaacagtgaaaaaaggaaaaacaccatagaagagtctggggcttcccattagggtttcaagaggtattgcctctcttcctgctgggaatggtgtttcccctgtttcttcactttctctatcttctcttttcccatttggcctactataggagacctattgctcacctcagaaattctctgctgcttgcagagctgtctgttttagctgcagttagggtttggcttaggagcaacatagcatccctccatgagaggtcaaatacctgagttaaattctggaaaacttctatatgcctatcagggtcattagaaaattggcctaagtctccctttaattgcctgaggtcctgcaatgagaagggtacttgaatcctggtggcatcacctcaattatgtattttctgtaggggtaagtgagaaggtgatggaatggaaaattttagagatggtggaggtagaagaactggtggcatggttggaggtggccccggttaaggcagactggaagggctggtacacacaatagctgcctcgggtggttcccctggaagttgcttttctcattttggggaattattctcttttggcctgcctgatatgattgctaaaagagctggattcattttgcagtgcttgcaaggatctagtaaaaaggccatgcccttgtgcaaaagaaaatgagctgctttttctttaaagtctctggttaagaggagtccctgtgcttcagaatgcactccaggggagtgcaggctgaatatggtacccatctagaaagagaaatgacaaaaaagtatccctttagtctccttccttttcgtgtgacagagtggagaggaagacagtgggggcattccccttgctatattccttccatggttcctgggtcccggcaccttgttgaacatgccacccatagttgcaggcatgactgccagctatggaaacagaggcacttagagattggggtttgtcacactcacccaagtggctctagtcctctgtcctctgcctgtgatttccctttgacttcctagacttgtgtgacctgtctggctccctgaaaaatagatctcaaaaaaaaaactacataatagttgggcaagccctctttaatggaggggctagactgaaatctatacctgatattatgggctgtactaaagcgttttcccttagagaatggttctggttaacttccagacttaaaatccccttactaattaagtaccattctaattggaggcagaataggtgtcttaaaaatgtatggactaaatggcaattttcctgctgatgggacagtatcaagaactaacatttggttccagaagacattttaatcctaattgttgaagctagagttttcctgttaacagaagcagcataaagcatggtgtctagtagagggatgcaaaaagggagagaattggttagctagagtgtttgggtaaaggaccaacgatgtgcctcatggaaaagatccctattccactaggtggggctgttggccttgaaatgtcatgtgcttttcagaccaagggcagagagagatgctccctgtggtgagggtgaccctctgttcctcgaaaatcacaaagatgccttcccttgagctatatcgctggttactatgacattccctgatcttgccaaacaagattacctccctgaactataaaatttcccatacattgcatacacagagaggatgaaatagatatgatgatcgcagacaggaaaggaggaaattatgataaaaagttggagattctgttgccgacatctcatcagggtagtcagaggctggggtccgtccaaatacctttggataacaatggtggtaaccctggccggaaatcctcaggtacaccaggacttcttccagccccacatgacagctaagtcctccgtgaaaggaagctggttcaaacagggccagtatgcccagtgacccatgggtactgggggatgctccatgttctccctagcaatcctgtcccccaagtcttgtaaggctggcagccatgctaattatttttaaatggctgaaaggggccccgtatttggtttgatctggttctaaaatggaagccaagggcctcagaataaaaggacagagttggagtctgctcctctactcaccatctcgatgaatgttgtatgttgttatcccggacgagcccccattataaagcagctatgtctggggtgtaaacccagggtttgtcgtcacgcaccaggaaaatttaggacacagacacatatgagaagtttacgagcaaaggtttaataggccgaagagaagagaaagagaaacagctttctctatagagatacaggtctctgagtggaaaggactggctggctgcaaatgcaccaaaatatatagtccagtttgaggaggcagtgtctgatttatacagggctcatagattggtttgatcaggtatgatgtttacatagagtgcagagaaggctggtcaccccaccttaatcttattatgcaaataggctttccagttgatcggcaccatctcgtctgctctttacagtatacatggctggcagagaagggaagaatggagctgccatcttgaaaatgtctagtcctcagttcctgccaacattcacctgtgcaagctctcagctcacttgtctacctctgcagctcaactttccaggctgctctttgttagtaaatgatttggggctgcttttcatgaggtaaaaagtgtgactgaggattcccaaacccttgctatctccctaagtgatttctttttaacttctatatcaaagagactggagatttttttttatgagaactgcatattgcctctttggtttggtttgttttaaaggcaggttatctgtggaaaccttatttatatattaatttgtttctcttactggagctgaaaaactttttaaggagggatactgtactatttaaatacctttctgaagtcccctaactcccagcttcaaacacagctggtttaccaaaaaaaaaaaaaaaaaaaaaaaaacccatggtacctactatagaattcagaaattttactaatgatgactgtaatttaaaaatcaaagttctcaatggatttttctatagaaggatttctaattataatgaaatttaagtggaataatcataatacttttattgagttgccacttgtgtctttataaaacatatgcttcagaggatttaatcttggtttgtatttttttcctttctgcacattgagttgtggttcagtagatggaagatctaaaacataacaattatatatttaaactgatttaaactagagcctaaaaaataggataaaacaagaatgggatgtacctcattttataatatatataaattcagaaacatttatcaacatatataaataaaatattattttaaaaaatggcttcttttcagatcttaggaatgagtaattcagttaaggcagtaatgtggaaattttgaaatgtggaaatattattcaattttaaggacaaatatggtatattagtctgatctcatgcgggtaataaagacatatccaagactgggtaatttataaggaaaaaggtttaatgaactcacaaatccacatggctggggaggcctcagaatcatggcggaaagcagaggaggagcaaagtcatgtcttatgtggcagcaggcaagagagagagcatgtgcaggggaactcccctttataaaaccatcagctctcataagatttattcactactgcaagaatagcatagggaagacccaccctcatcattcagttacctcccactgggtccctctcatgacacatgggaattatgggagctatcattcaagatttgggtagagacacagccaaactgtgtcattctacctcttacccctcccaagtctcatgtccctttcacatttcaaaacacaatcatactttcccaacagtccccaaaaggtttaactcatttcagcattaactaaaaagcccacagtccaaagtctcatctgagacaaggcatgttccttcctcctatgagcctgtaaaatcaaaagcaagttacttacttcctagacacagtggggtacaggcattgggtatatatacacattcaaaatggaagaaattggccaaaacaaaggggcttcaggctccatgcaagtccaaaatccaatagaacagtcattaaagttcgaaaatgatctcccttgactccatgtctcacatccaagtcatgctgatgcaagaggtgggttcctatgtcttggggcaactctgcccctgtgactttgcagtgtagagctccagctcttgtcatgagctggcattgagtatctgtggcttttccaggcacacagtgcaagctataggtgtatctaccattctgggtttctggaggacagtggccttcttcccacaattccactaggcagtgccctagtggggactctgtgtggggcctccagtcccacatttcccttccatagtgctgtagcagaggttctccatgagggccctgaccccatagcaaacttctgcctggacactcaggcatttccatacatcctttaaaatgtatatggaagtttccaaacctcaattcttgacttctgtgcacccacagtcccaacaccatgtgtaagttgccaaggcttggggctgcagatgaaacagctgggatgcaaggcaccatgtcctgaggccgcctacagcaagtgggccctggggtctgcccattaaaccatttttttcctcctaagcctccaggcctgtgatgggagggactgccatgatggtctctgatatgccctggagacattttccccactgtcttggtgattagtatttgacttcttgttacttatgcaaatttcttcagctggcttgaatttctccccagaaaattggtttttctttcctactgcatcatcaggctgaaaattttccaaacttttatgccctgtcacctcttgaattctttgctgcttagaaatttcttccaccagataccccaaattatctctctcaagttgaaagttccacagatctctaaagcagggacaaaatgcccacagtctttttgcatagaaagagtgacctagttcccaacaagttcctcatctacatctgagatcacctgaatgggacttcattgtccatatcatgatcagcattttggtcaaagccattcaacaagtctttaggaagttccaaactttcccacatctttctgtcctcttctgagccatccaaactgttccattgtctcccagttagtcacttccaaagttgcttccacattttggggtatctttacagaagtacctcactcaaccagtaccagtttactgtattagtctgttctcacactgctattaaagacatacccaagactggttaatctataaaggaaagaggtttaatggattcacagttgcatgtggctggggaggcctcaaaaatcatagcagaaggcataagaggagcaaagtcatgtcttacgtgttggcaggcaggagagagagcataggcagggaaactcccctttacaaaaccatcagatcttgtgagacttattcacggtcatgagaagcatgggaaagacccaccctcatgattcagttacctcccactgggtccttcccatgacacgtgggaattatttgggctacaatttgagatttgggtgggaacacagccaaaccttgtcatatggaaatacaaataattaataataataataaacataacatcagctgtttgatcttgaattcaatgaaattattgaaattattagctattgatagcctgacatatttattaatataataaataaattgtagtctccacacaattttacaaggggctgaatgagaggtgaatttcattctatcaattcttttttttttttttgagacagagtctcgctcttttgcccagaccggactgcagtggcactatctcggctcactgcaagctccacctcctgggttcatgccattctcctgccccagcctcccgagtagctgggactacaggtacatgccaccacgcccagctaatttttttttttttttgtatttttagtagagacggggtttcaccgtgttagccaggatggtctcgatctcctgacctcgtgatctacccgccttggcctcccaaagtgctgggattacaggcatgatatttttctttttattatttatttatttatttatttatttatttatttacttacttattttgattcagagtgtcactctgttgttcaggctggagtgcagtggcagaatcttagctcatggcaacctccacctcctgggttcaagcgattctctttcctcagcctcctgcatagctgggattacagatgctaccccacccagctaattgtgtatatttagtagagatggggtttccctgtgttgaccaggctggtctcaaagtcctgagctcaagtgatctgcccaccttggcatcccaaagtgctggaattacaggtgtgagccaacgtgcccagcattccatcaattctgatttgtattttgtatagaaaatgaaaaatttctaagaactccaaagcctcaaacagttttatataagtacttattatgccattggattctttcttaagtaggatatgatttgtattcaaaatttttaaataattagtttgtaattttcacagaacaataaggatttttttttctgttttgtgtttcacaaaacctgaaagtctcccataggaaattggagtattgaagctgaagttagcaagagcaaaacaaatggccactatttaaatgagaactagaaaagtctaagagaactgagttcacatggttttcatcctttgttactacagtctccatttatacttgaactcggtttcatctttttgaagagttactgcttttcttctagtgaagagaaaataaatacgtgcttgcttgctattccattaactgaaaccaaactaacttgctttttaagttttcagattcttttgatatcttatagtttaatatcattattttatcgcagaagatgtttatcttttgccctctgccaagtaactttctacagttattaaatccatcaagttcatctcttgttgatcatcatagttgaagaaatcaaggtgacagtttttttttttttaggcctattatggttgagcatggtaacatttttaaagaaattgtttaaaatcattatgacagtctcaaacttttaaagtctcaaatccattaaaaattaaagtttttaagaggattcctttaaaagaaaatgagatggagttaacacagtcttatttttaataatattttttttttaaatttgaagcttacactgaaaaatacatgtcacttaatgtccttcccctgactatataaatcctactaagggatcaaagaaaacaccaccttcatttaggctttcctggacttctgtaatatacaatgttattaccttttaccataattcctgtcatttatttagggtcagtgttgtgtccttcttgacctatattaactatttaatttcacaacaattctataagataggtattgcaattttttccccagacagtacactgagtgttaaagtaatttgtgtaaagttacacaaatagtatgtgcagaaatagaattgaacccaatccaataagactttaaagtctagacacttcccaacacacttaattgttcgtacctctcctttgtcagtaaatcttgcttcctttaaaacattctatttgcttaagatttcccgataggataacaaatttttgaagccacatgtcttgtcatgatataagtcaaatggttttgtgggaaacacaatggaccagggtcaggagacctcctaccaagttcttgctcagaaataactttaaagtaattcagaaatttcaaatttaaaatgaggaaagaattgtattccagggttgttgtttaaatgtaaatataaggaaggctttttataaggttaattcagtgtatgttattcttatatagaactatgccaatttggggtcctattcacaaaagagctgactaatacatattggtagaatgaatgaataatatgagttagagaaatatacaaaatgtacagtttttactcacttttttcctattgccataatctcttcaatgcatatttgcaattccattttatttattcatgtgctctacctaatatttacgcattgcttgctcttcacatttttgtttctgttaagaccttctttttcctttatttcatgctccttttctctctcttccctgcctcatagcgttctttgttggcaatcaaacagccaaaaattgcatgctgtctatttcatgcctagcaaaagatgcttctattcttgtctaagacttggctggctcatgtcaaaattctcataccatctcctctccagtctttcatattgaaatctcaagcatttctccagaaattccctgtgtacccaaaccacttcattaaaggcttattcattttattcattaaatacatgcatctatttctctataataaggctagtgtttagttttgtttcctcccaccccaccttccatcctaatggaaatattaagtaatatttaataaagactgaaaatttgctgcaaagaaagagctgtgatttcagctctataggcaatctgctgagagcctcatagtactaaaagcagattatctgataatgcttgccatactgatcatttcatctaccaaggtagatgaaagttagataaaataaacaggtaaaaaatatttactcaggaattatttcatattaatcaaggaaaaatatgctcatataaatacagaaaggtgatgaaaatcttggaaacatatggctgacattataaaataaagaaagggaaggagactggttacaggtagatttctcaccagcttttttaatgtgtgtatttttcttacatttatttattactctaaatttctcttttgaaatttgctattgtccattattcatttttctactagcattgccattttttattaattattaatataatattaatatctaacttaaagacttaagctcctttatggtatctctatttaaaattttcccaatgtaaaaaattgaattgtttattttcttgttgttgagtactaagattactttctatattctggatacaagtcagatctgtgattaccagatacttcctcccagtttgttatttttaagagaggaaaatgttacattttaatctatttaatctattcaatttgcactcataaccccttttattacatttatatttagagtccttctcagttaaatatttatacaaaatttttcctcacattttatattttatttacaatttccatagtatttcttatcctataactgacatctaaatttatatacaacaaaatccactttttgaaaaaattctctctttattgcttttgacaaatatacacatttttatcaccagaactaggtacagaaaattttcatcaacccctccgccaaattgcctaaatgtaatttgtgccagtctcttttatcttctgcaattgctgatctgatttttattcctatagttttgtcttttccagaaagccctaaatggaatgatacagtatgaaaccttttgagtctaatttctttctcttagcataatacatttggaatttttccaagccattgcatgaactactagtttgtttctctttattgatgatgagtattccattgtatggatgaactacacttcgttaattcattcatgttggaaaagacagtctcatgagtacagtctttctcctacttagccacctaatggattttgggcctggaatactttcttaccaagataaaaagagtgcacaccacctgtgcagggcctattgccttgtgtgagaatatctttctccgttgccagcctagtatatgtccctttgttctgtttaagcaagtgtatcccttggcacttggccagctccactgtggggagggaatagggaccttctgtggtactcaaggagtgtgcatggacaattaccctgcattcattgctgggagagaccccctggccatggggtattgaaaaatactctcagaatgaatttttctctgtttcctctctatgtgaataaagagttgttccatccagtgcttgactgtgttgtgattcccatgataactgcaataccaaaatgcaatgggcagaaatatttggagtcttctccagggattggcaactggtgcatggtgttctgcttaataattcacctatcgaagaacatctgtgcttttttgctttttccaaatttggcaattttatatacctggagtaaataaataaaccttgtgtagattttctgtgaacataaattgctatttctcttggatgattacaataagattgctgagtcatatggtatattttactttccttctctttctttccttctttttttattattatactttaagttttagggtacatgagcacaatgtgcaggttagttacatatgtatacatgtgccatgctggtgcgctgcacccactaactcgtcatctagcattagatatctctcccaatgctgtccctccctctttacttctttctttctttctgcttttttttttttttcttccacagagtctctctgttgcctaggctaaagtgcagcagcagcatattggctcattgcaatctctgcttccagggctcaagtgatcctcctacctcagcctcccaagttccaagtagctgagactacaggcatgtgccaccatgcccagctaattttcatattttttttgtagaaacagggttttgccatgttgcccaggctggtctcaaattcctgtgcccaagccatacatccatacatctgctttggcctcccaaagtgctgggattacagtcatgagccactgggccaggttgatatgttatatttcttaatgataaactgccttaataataataataataaactgcttaatgaaaaagataaatatttctcttccccaaatatctataccatttcatattctcaccaataatgtatgagtcgcccttgcttcacatctttgccagcatttagtttctttttttcactgtagtctttctaatacttgtgtgaaattatctaattgtttctaatttgcattcttctaatgtctaatgatggaaatattttcatgtgctaatttaccagggtaattagcatattattcacctcaaatacttgtcaaaatcatctcttcttgctactttgaagtatataataccttattcttggctatagtcacactactgtgcaataaaacaccagaactcattcctcctatctaactgtaattttgttccatttgactgacttctcccctcccctcttccctgctactctttccagcatctggtaaccactatcctactctctacttcaatgagctcaacttgttaagattccaattatgattggtatcatgcattattaggccttaggtgcgtggcttctttaacttaacataatgtcttccagtttcatccatgctgtcacaaataacaccatttcattctttttttatggctgagtagtactccattgtgtttatataccacattttttatctgtgtttagggaatcccaaatcatgcctatctatgttggtgaacttaatcaataaacgtttgtgttctgactgctccaccaatgggccactctcccttttgtgtcctgctccttggggcttccctgttgtcagagacagaacaatattgaagttaggccaattaatcatctacaatggcctctaaattttcaactggaagaaagagtcacatgcctctcactttaaatgaaagctagaaatgattaagcttaatgaggaaggtgtgtcaaaagccccgatacactaaccagtctaggccttttgtgccacttagtcaagttgtgaatgcaaataaaaaatttttgaagaaaaatttaaaaatgctactccagtgaacacacaaattataagaatctgatatagccttattgcagatacagagaaagttttagtggcctggatcaaaccagccaccacattcacttaagccaaagtctaattaatagcaaggccttgaatcttttcaactggctcaaggctgagaatggtgaggaagcttcagaaggaaagattgcagctagcagagtttggttaatggagtgtaaggaaagtagccatctctataacctaaaagtgcaaggtaaagtagcaaatactattgtagaggttgcagcaagtcatccagatataagataattgataaaggtggttacacgaaacaatacagtttcaatgtagacaaagcagacttgtattggaagaagatgctatctaagacttccatcctagagaggagaggtgagtgcctgcttcaaggcttcaaaggacggctgactctcttgttagagataatgcggctggtgaccttaagttgaagccagtgttcttttattgttccaaaaaccccaaggcccttaagagctatgctaaatctactctgcctgtgctctaaaaatggaacagcaaagcctggatgacagcatatctgtttatagaatgctctgctgaatattttaagcccacagttaagaactactcttaagaagaaaagcttcctttcaaaatattactgctttatgacaatgcacccaagagctctgatgaaaaattacaaggagattaatgttgttttcatgcctgctaagacaacatctatcctgaagctcatggatcagggagaaattttggatttcaattcttattacttcagaaatatatttcataatgctatagctgccacagattgtgattcttcagattaatctatgcaaagtaaattgaaaatctctgggaaaggattcaacattttaattaccattaataacattagtgattcatgggagtgggtcagaatatcaatattaacaggaatttggaaaaagttgattccaaccctcatggatgattttgaggggttcaagacttcaagtagaagaattaactacagatgtggtagaagagtaagagaaccagagttagaaggtgagcctcacaatgtgaatttatacaatcttatggtaaaacttgagtggatgagaagttgcttctaatagataagcaaagaatgtgcttttttgagatggaatctgctacagcaaagatgctgtgagccttgatgaaatgagaatgatttagaaaattacctaaatctagttaataaagcagcagcagggttttagtgtattgactccaattttaaaagcagttctactgtgggcacaatgttatccaacagcattatatgctaccaagaaatctttcatgaaaaaaaaaaaaacagtaaattcatgtggcagacttcattgttattttaagaaattgccacagccacccaaacattcagcagccaccgccctgatcaatcagtagccatcagtatcaagacaagatcctctatcagcaaaaacattatgccttgctgaaggcacagatattcattagcatgtttcagcatattttaaaattaaagtatgtccattttttaaacctaatgttatagcacacttcataaactacagtgtggtattataacttttatatgcactggaaaagcaaaaaattttgtgactcactttactgtgatatttgctttattgtaatggtctgaaatcaaaacagcaatatttcccttgtatgcctatatattcttaatattaaccccttttcaggtgcatagtttgcaaatatattctcccattctgcaggttgtctcttcactcttgattttttcctttgctgtgcagaagctttttagtttgatataattctcttatttgtttactttttattttgttgcctctgcttttcaggttttattgcaaaaacctttgttcagatccacgtcataaagcatttttttcctgtgttttcttctagtatctcatagtttcaggtcttacatttaagtctttaatccaatttgagttgatttttgtaagtgataagagatacggttatagtgtcattcttcaacatatgagtatccagttttatcatcaccctttattaaggagactgtcccttccctaatgtgtgttctgatactttgtcaaaaagcaattggctggaaatgcatggatttatttctgggttctctattctgttccattgatctatatgtctgttttttatgcaaataccatgcaagcatgaatttacaaggattccttgtacttccttttttttttaaatcatctcagaaagattggtattatttctttctttaaaagcttgatagaattatttggcagtgaatatatccagtgttgaactttcctttctgaatcaatatcattgctcattactggtctgttcaggtgttcagtttttctgtgtcttcattattcaatcttggtaggttgtacatatccataaatttatccatttattctaggttttctaatttgttaggggtatagttgtttataagagtctgtaatgatcctttgtatttctgtggtatgtttatttttagtctatgttctgtttatgctctgatctttattatttcttcactctgttactagtttggggtttattttgttctcatttttctaggttttagaaatgcaacttttgcttatttctttggaatctttctacatttctgatataagtgtttttgctataaactttcctattataacttctttttcaacatcccataggatttggtatgttgggtttccattttcatttgtatcaatattcttcaaaaatgtttcttcacaatttcttcattactcattagttgcccaggagcatgttgtttaattttcatttatttgtacatttcccaaggttcttcatgttattgattcctagttttattatattttggttagaaaagttatctgatataattttaacatttttaaatgtgataagactattttttttacttcacatatggtctatcctggagaatgttccatgtgctgctgagaaaaatacatattctgaggctgttacgtgaatatttctgtaaacatttattaggtttatttggtctacagtgtggcttaactatgtaaataaactatatttcactatatctggatgatctgtctattgctaaaagtggggtgttgaaacccaccgctattattgtactgcagtgcaatctctttctttaagtctattaatgttttctttatatatttaggcactcctatgttgagtgcatgtatatttatatttgttatatcctgttgctctattgactcttttatcattgtgagtgtctttatctttctacagtttttggcttaagctctattttgcctaatgtaagtatagctactcctgctttattttagtttccatttgtgtggaatatctttttcattccttacttcactttcagtcttcgtgtatctttatagatgaaatgagtttcttgtatgcagcatatagttgggtctttttttttttaattcattcagcctttctgttttattttgattgaagaatttcatttacatataaggtaaatgataggtaaggggttactactgtcattttgttacttgttttccagttgatttgttgatccttttttcatttcttcttttacatttgttctttgtgattaagtgattttttctagtaatatgctttgattccttgttttttattcaatacctcacaattgctgtgttttccctctctaaattcccagagatgctctctgtcactgccagggtgaggaaggggtggtgtcagtgattcaggtctgtttattaaaatctcttattctagtttctatttgtgtgaaatatatttttcatcccttccttgcagtgggagagggaagatctttgtagctttctatttgccatcttcttctgcctccctcacaatttatatatttttaaatattgcctatctcttaataataatagctaatatataaaaatataaaggtcttgaaggagaaataattgcagcctcaccttaagttataatgaatttatcttttagaaggctcactttaataaaatgtaaaatttaaatgattactaatttgcatcacttctttgtattataatttttagatgattgaatttatcttattacactgtgttagtgccttgtttcctgcatcttaatatgcttcttccttggtgattaattttatatttcattactctgtgcatttatgataatatgatatcttctgaaacatgtagctttcattagtctcacaaaaatttccaggaataccttaacaatgcttaataatgttaatttgttcctctctgtccatctcattttgtttctcactaaaaatgtaggtttttctgttagttgaatgataattagatttacaggtttctgtgtgatataatggaaacagtacttgataaaattcagcagcctgttttttttcctaacatttattaattttgtgaccttcagtatgttaatgaattctattgaactttttttttcatctgtttatagggtataattatttctaacctattatctcctttttgttatgggattacaagatatttaagagtctagtaaataactttaataagttatgtagtttgaaattacagcaatttgttcaacacctataaattccttttcagtacacacagtattttaaataactctgaagaatgaaaatattacatgaataaaaacttccttaatatgctagggtcttccttgctaatgtggatttacctggcttagatggattctctcctttctttcatttccatatactagaatttgcattccataaatactctttttacctcctattcttcatccaaactttgcactcaagtctgatttatgctctactgcttcactaagacagtgctgctacaggttactaaccaccatgtcttgctgccttctttcagtcctagttatctttatttgcattatggcatttaacactatagggcacctttccattctggaatcatcatctttcttagatgcatgtaggtctcctctatttccagtgacctcttttctttcctgcagtaggttgaacaggcttgtgtataaatacctaagctttgatattagaactgattttaagttcttattctgtgtccctttaatagttatttgaccttgagtaagttgtttaatctctctgctgtagtttcttcatctgggaaatgaggataatatttcattccagtctcactgggttgttttgaacattcattgagattatgtgcataaaagcttacccaactctaactctcaataatgttagatgtcattgatacattttttcaacatttttaaattttatttttaactgacaataataattgtacgtattcatggagtacatagtggtgttttcatacatataatgtatagtggtcacatcacactaatttagcatatccaccatccaaacatttagcatttctttgtattgagtgggagtattcaatctattattattattattttcaaacaacctttcttccctttaatcgtttatttaattctgagcaaaagctctggcgtaagctctctgttctttctcttcactcagtttcttggctttacctctcatttttacacgtacacccatatcccccactgcccagacctctcatgagagctccattattaggttaatttttgagtccaaaatgtcgttttgtagattccttgtggtaatccatgtgtccacaatggaacacaagattccctttcaaacatcagcttctactgcctggctatcctatctgttagttggtctatcagactacaaactatgaaatcattcttaattctttctttttatgcattacttagccctagacaaaatatggtaccaaacaccatgatttctttgtagaagtggctttatgattaactctttctttgctttctgttgtctgtgacctatttaaagttcttgtcatgtcacaattggatttttttcagtagcttctcaatggatctctctcacacaccatttttgcctccagtcacccttatgaacctttgccagaaaaatatttttaaatattattttcattctataactttcatgcttgagacataaactatctgcattgcctagtgtattactaggttgcaactctgtctgtcttggggacttctctttattttagtgctttctcccattgttcacccatatgggccctatgattcagaaaaatctaatgacaaccaaaaacatactttatgtccatatctgtcactccactccctataaagctctgtcccatatctagaatatcctctcatatagtgaagtatttcttcttttctacccgttctttgtggcctaactaaagttctaacctctccctagaattatttcttcccttatattttttcttacttctattagaaagacaggatgctatcactgtaagttatggaaattaaaatcaagcaaaaagaatctacttgtttatgtaattgtgaaaaaacagggatatagtaggggccactaaaaaaatataaccagggattttatactgacagatttacctccttacacctattaatttcccctcttttttatagaggcattgttctctcttttcatttcttcatgaggttggaaccatgactaatgactgctgttggctcacatttttgaagagaataaaaatatttttcaaggaataaagtgattctctattagcttgagtttgaaaaacataagcaaaaggcccgatgagcagtttaggtaacatctcagtcctttaagccaataactgaggttgggggttgaagagttataaatctaaaataaaattatactttattaatataaattattataacacttttaaaaatttatgccttacaatttattaagtaaagtggatcatgtacacacatcaaataaacagagaaacagggatctatttccaggaaaagggattatgaacagtcattgcattgctggagttcttggaaactggacaggtaccattttttgtatcaataataatgagtttttaattaaaattaaagcacatccatgattatttccttttttccatagctacctacacaatttcataaactcatgacccagtgtaatcctgagtccttgaaatgtttctaaaagtgattcaccctttcagtgaaataggaatagataggacttccatttccaggatttttcttagccagaagtgtcccctggaggcttgggcagaattacagatatcttgagattaaaggaaaaaaaggagccacattggctgcttccatctgcttcagagcaaaacttgctattcctgtgtgttaggtaatcccaagtggtttttacattctggtatctcaaaggtatgattaaaggattagtgtggaaggaaaacagcagacattagtgcagcagagttgaaaaaagccaatactttggtactatcgtgggatttcatcagcagcaaaatgaggacaggagaattagaccataagtgattttgttaaaacactaggggaatccaatcaaggtgctttagctattaagatccctgattacaggggttatatctgttccaatttgctttgtgaggtgcccacataggcaatagagacaaggaccatgtttttaagaagtactaagacgctgttactttggaaaaactactgaatactcagtgcatatctaatgagcagttttagttttaaatttctagaaagaatgcttggcaatagttgaattaacatttgccaggtatctaactgagaatataagttaggagccataggtattagtgaaacatggagaatagatggttttcattcaggaatgtgtcatagttgtgacaaacaccaacaactaagaagttagtagcaaaataagaactcataaaaatgtgtgtaattaatattaaaaaatactactctagccttatttatatgtcaggctctgatataagcactttccatgcaaaatcgcatttaatcctcataaccaccttatgaaaatgttatagatgagaaaaaaaagacttagaaagattaataacttgctcaaacatccaaactagtagatgtcagagccgggatttgaaatcagctttgattaattcaagtgaagttcaaatttcatctaatttcagagccattctcataagagctctttatgattgcctactgagaagaagaaattatgagagctaagacagaaactaaattttgttgagtgtctatcctgtgccagactttggtctggtgattggcctactatatctgatatgattaaagaaactgaagctcagagacatttaaataacttgtctaaggtcatgtatctaggaaattgtggatacaggaatcaaactcagtctatatatggcaaaggccaatgccctttccaagtattatgatctctatgacaataaaattaatttcatgtagcctaaggatttgggtactttttgtgactgaaagttttggtcagctgcagaggactatattagttagcttgagatactataacaacaaaccaatagactcagtggttcgtaaacaacagaaatgtatttccttatagtttagaggctggaagtccaagaacaaggtctcaataggctgtgttccttctgaggatctgtctccttggcttgtagatgccatcttctccttgcatcttcacacgataatgtgcatgtctatttcttaatctcttcctataaggaccccattcagctagattagggaccacccatacgatttttttgccttagtttcctttttaaagaccttgtatacaaacacagtcacattctgaggtacttggggttaggattacaacataggaattttctataagacacagtttggcctataacaaaagccagcagtgctctgacatgacactaagaagttaatataaacttcttatgaaaaaagacgcaataaaacatcctaaaactgaacagcctatgtatggtatagtctttgctttcatcactttctttcaagttactgttgtttctcatctggactccttactacattagcctctaaactaagcttcttgaattttctcatattcaaccccaaatgaagtaacagtttgccagtaatttgtagatttaatgctatccccatcaagctaccattgactttattcatagaattagaaaaaaaactactttaaatttcatatggaaccaaaaaagagcctgtagggccaagacaatcctaagcaaaaagaacaacgctggaggcatcacgccacctgactttaagctatacgacaaggctacagtaaccaaaacagcgtggtactcatatcaaaacaaatatatagaccagtggaacagaatagaggcctcagaaataacaccacaaacctacaaccacctgatctttgacaaacctgacaaaaacaagcaatggggagaggattccctatttaataaatggcattgggaaaactggctagccttatgcagaaaactaaaactggatcccttccttacaccttttacagaaattaattcatgatggattaaagacttaaactaatacctaaaaccataaaaactctagacgaaaacctaggcaataccattcaggacataggcatgggcaaagacttcatgactaaagcaccaacagcaatggcaacaaaagccaagattgtatagcataattccaaagatcattatttactttgtattccaggagaatgtcaaactctaacaaattacgttaaaaagtggccttgcatattgtcaatgcttcatttcatggtaaacatccaaaatcaggcctttgttcattttatgtgcttttatttttatgtatttattttttattatactctaaattctgggatacatgtgcagaatgtgcaggtttgttacataggtatacacatgccatggtagtctgctgcaaccatcaacctgtcatctacattaggtatttctcctaatgctatccatccctagaccccaatcccctgacaggccccagtgtgtggtgatcccctccctgtgtctatgtgttctcattgttcaactcccatttatgagcgagaacatgcagtgtttggttttctgttcctatgttagtttgctgagaatgatggtttccagcttcatccatgtgcctgcaaaggacatgaactcatccttttttatggctgcatagtattccatggtgtataagtgccacattttctttatccagtctatcactgatggacatttggattggttccaagtctttgatattgtgaatagtgctgcaacatatgtgtgaatgtgtctttatagtaggatgatttataatcttttgggtatatacccagtaatgggattgctggattaaatggtatttctggttctagatccttgaggaatcgccacactgtcttccacaatggttgaactaatttacacttccaccaacagtgtaaaagtgttcctatttctccacatcctctccagcttctgttgtttcctgactttttaatgatcaccattctaactggcctgagatggcatctcattgtggttttgatttgcattaccctaacgaccagtgacgatgagtttttttcatatgtttgttggctgcataaatgtcttcttttgcgaaatgtctgttcatatccttcacccactttttcatggggttgtttttttttcttgtaatttgtttaagttccttgtagattctcgatattagccctttgtcagatggatagattgcaaaacttttctcccattctgtaggttgccttttcactctgatgctaatttcttttgctgtgcagaaggtctttagtttgattagatcccatttgtcaattttgtcttttgttgccattgcttttggtgttttagtcatgaagtctttgcccatgcctatgtcctgaatggcattgcctaggttttcttctagagtttttatggttttaggtattacttttaagtctttaatccatcttgaattaatttttgtaaaaggtgtaaggaaaggatccagttttcgttttctgcataaggctagccagttttcccaacaccatttattaaataggggatcctttccccattgcttgtttttgtcaggtttgtcaaacatcaggtggttgcagatttgtggtgttatttctgaggcctctgttctgttccattggtctatatatatttgttttgatatgagtaccatgctgttttggttactatagcttgatggggatagcattgaatctacaaattactttgggcagtatggccattttcacagtattgattcttcttattcatgagcatggaatgttttcctatttgtgtcctctcttatttgtttgagcagtggtttgtagttctccttgaagagttccctcacatcccttgtaaggctggttcaacatatgcaaatcaataaatgtaatccatcacataaataaaaccaatgacaaaaaccacatgactatctcaatagatgcagaaaaggccttcgatgaaattcaacacccctttacgctaaaaactctcaataaactaggtattgatggaaagtatctcaaaataatgagagctatttatgagaaacccacagccaatatcatacttaatggtcaaaaactggcaacattccatttgaaatcctgcacaagacaaggatgccctctctcaccatatttaacatagtattggaagttctggccagggtaatcagccaagagaaagaaagaaagggcattcacataagaagaaaggaagtcaaattgtctctttgcagttgacatgattgtatttttagtaaaccctatcatctcagcccaaaatctccttatgctaataagcaacttcagcaaagtctcaagatacaaaatcaatgtgcaaaaatcacaagcattcctacacaacaataatagacaaacagagagccaaatcatgagtgaactcccattcacaattgctacaaagggaataaaatacctaagaatacacctttgttcattttaaactctgtcattgtaatactctattgtatccttctggagcgccactgtactctcttaacctattattgccagtgtagccttacttgcagtttaattcatgttacctgccttcagaaacctcttctattgcacctctttatgtatcaagtttgggcctcccccttgtaatcttagcctacttgccctcccatcatatagcctcaactgtaggcagactggattttgaccacatactacccactttaacctgcctatgctctgtttactccatctagaatgccaaagtcaactccttctgcagggtcacatttaaattatactttatgaacagaccttttcctagtacagcaaaacagaaatgacagtattttccattctacatcattaaacgttcacctttattgtactggatctttataaaaagggagtctctattatagccagttaagtcagtggtcccttcaaagtcatggagtaactgaaaatatgacagagatcattgactagaagaattttaggatattttattggcatagtccagtgttgtgctggaaccagctcatctaggcaattgtaagagaaatgttaaatttttaagtgtctcttgttaaacacagccattattaaaaattaaattctataaacaataattaagctataaaaaaataaaagttaaatatcagacaattctaattaaacataattccttttaacatattttacagttttttatgctctttaggctattttcagctctactgtctatgtggtcaacataatatatatgagtgtgttgttcccctccctgtgttcatgtgttctcatcattcagctcccacttataagtgagaacatgtggtgtttggttttctgtttcccaattcatttgctaaggataatggcttccagcttagtccatgtccctgcaaaggacatgatctcattcatttttatagctgcataatattccatggtgtatatgtatcatttttttttaaatctggtctatcattgatggacatttgggttgattccatgtctttactattgtgaatagtgctgcaatgaacatacacatgcttgtatatttataatagaatgacttatattcctttgggtatatactcagtaatgggattgctgggtcaaatgacatttcgactctagacctttgaggaattgccatactatcttctacaatggttgaaataatttacattcccaccaagagtgtaaacgtgttcccatttctccacaacctcaccagcatctgttatttctttactttttaaaaatcaccatctgactggcatgaattggtgtctcattgtggttttgatttgcatttctctaatgatcagtgatgttgagctttttttcatatctttgttggctgcataaatatcttcttttgagaagtgtttgttcatggcctttgcccactttttaatagggttgtttttttcttgtaaatttatttaagtttcatgtagactctggatattagaccattgtcagatggatagattgtaaacatttttccctattctgtagatggtctgtttgctctgatgataattaggaagagcatcaggaaaaatagctaatgcatgctgggcttaatacctaggtgatgagttgataggtgcagcaaatacccatggcacaggtttacctatgtaacaaacctgcacatcctgcacatgtgtcccagaacttaaaaaaaatgaaaaaataaaatcttccctgtagatacaatatcaatactacacagtccttgtcacactagtcaccatatagtaaaaagacaaacattaaattttataattagagtaatgcaactattggcaccatagaaatatgcagtggatatatctattgacatttattctatttgaatttaaaactgaggatttttaagtgtttgttattcatttactctgcatgttaacataaataatgtttttatgaaaatgactatatttccccaaaaaacaataaagtttgctaagtgaaataaactagtcacaaaaagaaaaaatatatatataacaaaacaatgtaggaagcaggtctaaaaatccactctctaaggtttcttagaatacatataattttgtaattgaggagacaaatttacataaaaaaggtaagccatttcccaaaaaccatgtaagtgataaatcaaacaaatagattttcaatcactgtctcctcactctgtcgagggcacttgtgactaagctgtgctgtccttgataatatatcttatcttagcccagtttagtgcttttatatcacaatgaatgcagagtagcttcagtaacagaagctgctatacacaatgattcatagtggatgctcagtaatttacttatgaaaaattgctgctcattttctaaaatttatttattcaacaaatacttaggttgcctaggcccttgagataaagagggtaattaacccctttgtttaactgtctcacagtcttttatggagtaagacaaatatgtaattacaataaaacataaacaatatcctatgacattggaggggagttgagcaatgacagcacagtggaagatatctgtttagaactgtgggccaggtgtggtagctcatgcctgtaatcccagcactcactctgggaggctgaggcttcccaaagcctcctgggattgcttgagcccaggagttcaagaccagcctgggcaacatggagaaatttagtctctacaaaaaaatacaaaaattatctgggtgtggtagtgtgtgcctgtagtcccagctaaccgggaggctgaggtgggaggatcacttgagcctggaaagttgaggctgcagtgagccgtgattgtaccactgcactccagccttggtgacaggggtgaaaccttgtctcagaaaaagcaacaacaacaacaataaaaacttaatttagagaattctgtcactttcagccaactcttgaaggatgggtaggaattagctaaatagaagggtattccaggaataagagagattgtgtgaaatttagagatgtaaaaaagcctagtgtatttgatctacatatcctttgttatggctggagcatgtgctgtgcctcaggaaaaggcaggcagtgagactggagagaagagtcaagcagcagatcatgaaaagtttggatgccattaaatatcctaagaagtttgaattctaccctgaaatgtataggatctaaatttctttgcatgcctaaagtggtactgtctaatagaaatgtaatgctagctatatttataattttaagaaaaagtaaaaataaatgatattaaatttaataatacattttatttaacccaatatatctaaacttctatcattttaacatgtaatccacatattaatgggatattttgcattctttcttttgtattaagtctttgaaatgtattttgtggtttacactgaacatctcaatgtggcaagtggctattaactggacagcacaagtctaaattatagaggaaagtcaccaaggctctaatgcctgaacacagcatagttacccactcttaaatgaggctcaaaatttggcaacaatgacagtgcagccattatactacattttaattcttccttctcatttctgaatccaaattgagttcctcctctcagtactttgtttagacaccaagtccttccaaagggaatctggctacaacagaacccagacagcacagatctaaactggagaaggtagcggcaggccagggagctgctgtcaaagaagcgactttttttcagcaaaagctgtcaagcatgaagagttttggctgcgctgtagaggattttctgccttcagctggtgatgggagaatttctgcattgtcattagatccagttagaatcaaggatcattggtggctagtgagctaaaacaggcaaaataaataactcaccgatccacccgacccattgacacacagctccgtatagagttttctcctttctgtggaaatggaattacttttaatgagacatgcaccgaagtcttcagctgtgaatttgacagcttacaaagaaagcagaaagaagttgaattctggaagcttagagtgggaatctgggtcatagcttctgtctcaagtttttattttcctctaggaagaatagccagaggaaaaaaatgaggaagactccaatatttttaagaagattaaaaaagtgattttttcattatgcaaatctcaaaccattttaaaaaataataaaagcttggaatattccaaaaaatttaacaccaaaatcactgtttttgtcattttctatggtctctctgaagtttctccctcttcagcaatgatgtagttaagtaactaatacaagataatatggtatgtctattttcaagagccccctcttattttacaggactttgtccatagaaaagctatgattaagcgttgtgtattttgtagaaaggctctgagatttaaacaccaactatcagcaacatggggactgaatcatttagtgctaaatcacatacatctgtaatcttttggaaattaagcaaaatacttatatattaaatattatgtttgctgagacaaattcaattcagtagtatttggaattagtttcaaatgaaacatttagtagcaggcctttggaagaaccacaggactaaattgaacaatttttacccagtgtcttaagagtaacaatatatggagggcaaagagcatgggctttgaaatttgacagaatgagggttgaaatttcagctcttctatttactagctgtcaattatttggcaaattgtttcagcatcaacaccttctttagaaatgtgggaaataatagcaacttcattaggttggttggttttaataataacacatttggagtgaatagtgcaataatttgttcatattattattaaccttttaccaaataattttacaggatctagataaatgttgaggatggtgatgatgatgattataaaaaaatcctgtattcagtgcttactctgttccatgctctgggctaagtactttacctaaaataaccccttcttaatatgagcaaagaaaacttcttgagtttccagattctcttctaatcaccaccatactcttagctcttgttcagtgccaagtgtctcaaaaaagttgtataaatatattgtcttcactttttttactcccattcacacaagcctactcctatatatcttctactatgttgccagaattagtggatttttttcactacacatcttactttagttttcaacagagtgttttaaaaaaaagagtgtaaaaacagtttcttttcctgatttccataagaatatattatcttggtttctcttcttcttcattgtctttgtgagctattccttctcagttaatgcacacatatttgaattctttagggtataactcagagctctctttccttcacttcctacacttttatctattattgttgctatccatatactgaggactcccaaatagttccaattcagacttctattctcttagccagaatgttcttatttaatttcctacttggcatttctacttggctatttcacagaaatttaaaaatttctttccaaatttggttttctttcaattatgtttgtatcagttcattcaacccagttatatgaactagagttgctggagggagtagatacatgttgagaatcaactttcgattccagggctcaggaatctaccaaaccaaatatgacactcaaacttgttgtcctcaacatgtatggcagttaaaactgtcacgtattcttctttaaataatctgatttcctgttttctaccatatctaaatttatttggtcaacatgtacctttgctcttaagatcaaacttctttctctaactccatacttgatagccagaagaaaattcaccaactcagcataccactcagcaaaccacttggcatgtacttttatggcaatattcagtagccctggttagtattcctttaaataatgttttatacatatagtttaaaatccacgagtggggcgatgcatagttataaacttataacttatctacatttgttacataattatactagcaatttgttttctgcttaatttactgttgaagagttcatcaaatgttacgacataatccattcctagagtaataactaaagcaaattttctaaatgagatccttctggtacttccaataataaacaccttggatgagattcaataatgccatgccttatgcttaatgctgtggtatatgggtcgtgttatagaaagactccagggcaggatgagaaataattgggccattgttcaaaacttggaaaactgtttgttaacaaagttttcgtatccatgacatttataattcaggtaccttgatgaaggtgcatgataatgataactttttattccagtcctttggctttaaaactttcacattaatcatatgtccaggttcctaaacacctaaatctcaattatataggaatttttaggaatatttcttggatcatttaacttccttctttctttccataaaaatatgtatacacatttcttgcatcatttaacttccttctttatttgcataaaaataagtatatacaatgttttgttgtgaaagaaatatctgcattaaaggacactgtctagtaacaggagataaatataaacaaatgagtgtaatacagagtttagaatgccacatccattgcacatatggctgtagtgggaaaaatggcatcaaacaaaagaacatctttatgaaactgttaataaaataagaagaggtgcttcactgtcaagcttttcccactcctggccattttggttaatcactagtttaagccacaaccctgtcaatatgggcagtttgggctaagatctcttgatgaacacttctaattcacattaaaggacacgaagtggagactggacactgcttatatgtatatttaggggatgatatcatgccagactaatgtcacaactcacatgagagatgactgagttttattttttatttttttgaaaattaaaacaactctcatttattcaagcaatatggtgacaaaaatttaataacatgacaataaccagtaatggtgaaggtatggagaaacaggcattctcatatgcttctaatcaaagtataaattggtgggaacttgttggagagcaagtttgctaaaatactaaatagttacactgtttgaccaatatttcaaattttgaccaagaaatttcatttttatttcaggattttactttatggaaatgaaaacaatcaaaaatggaggaaatttgtttcttgtaacagtgttcaaaatcatgaaaaactatgcacaacttaagtatcatctatacacatacagatatgaaaaagaccattggagtgaaaaagatcagtatgcgtgttacacaatcagtctttgttgttagctcattccctacttgcaaattttaacaaattaaaagttacatgccatataatgatgttttagttaatgacagactgcatatgccacagtggtcccataagattatatatggatctaaaaacttcctctcatctagtgatgtcatagctatcatcatgtcatagcagaatgtattacacatgtgtttgtggtgatgcaaatgtaaacaaacctactgtgatgtccgttgtacaaagataccgcacatacaattatatacaggacatcatacttgataacaatgataaatgaccatgttactgatttatgtattaactatactatatttttatcattattttagagtgtactttttctacttatatacatttaaaaaattcaccataaattagcttcaggcagatctttcaggaggtattccagaagaaggcattgttatcataggggatgacagcttcatgcatgttattgcccctaaaggccttccagtgggcaatatgtggaagtggacgtgaaaggcagtgatattgacaatcctggcctgtgtaggcctaggttaatatgtttgtttgtgtctttacttttaagaaaaaagtttaaaaagtaagaaaaacaaaaacaacaacattaaatagtaaaaagctcatagaataaggacataaggaaagaaaattttacttcactagtagttgtcagtaaaatgaactgtgtttacagtagcaacaggatattagtagttaaagccacttgaaatatactttaaaataattgtttatattgggaatcttaatttccttgtgaggaaaagataatttggaccaactaagatggaaaataaagttctattgtagaaggttacacttattccttttctttgcaaagatttagtatttcctgaagtgaatactttctgaaaaagtattttccacattcttttagcatctgcttggtgttctgcttagaaaaatgtatttactcttccaaaattttttttgcctatttttctgtactacttttctgtacaagaaatacgtaagtacctaccatgtgatgatatgtagttaaataaagcattaactaccctctatgggctcacagttttgaaaagaaggatatgtaaatacatccaaaatataatgaatatatgcaataggcaacatatataatacagaaatctattttaatttattataatacttagtaccttaactcatttcctgactctgaggcattttagaaatcccatgataaaacacattatttaaagtgagctatgtttcctaagaaaaaattcaacatcgttgtttatatttttaaccaagttttcagcatcaaataaatcatgagtataatcagccttgttataaaggtgaaggatccacaattataaacttttttagcaattacaaattacagagattatacaaataccgtaattaaataatggaactatggagaagatgtagtctccagcctaaaggaatctagggaattgaatttgtacaacatggaaaaatgtattccatgtagaaagaacagcattagtaaaaataaataaatgagaatatgtggggtgtctgtgatacatatgaaagagaatagtaaaaagtaccaaacaaaaaatagtggttggtagggtttgggaaaatgaaaaataagagatgatagataaaatagtatacaagcttctatgcagtgaatcagggtctgatttatggaaagagaagtaaagatactatgaaaaaaagaaaagtatcaaagaaaacaaaattacttgtatctttactattattataatagtttggttttgattctaatgatagttttccctaccacacgagattgataaattgaaacaatatatttaatggctattttgccagaaaaatgaaaatctcactaggtacaccttgtctatgctgttatactttattatctttatcttaaagtggccaatgtaacacagttgttaatgatattgaatttgtaccatctgaaatagcatttacctatgattacaaattacttactaaagtatgatttggtgccttttaatatacagttcaaataaaacatttttcctaggttagcagaaagttttttattttataatttaatttaatttaattttattttatatccagggtgttcatgtgcaggtttgttacatgggtatattgccctttgttggatttgaggcttgtagtgtacccatcagccagatgtgaacattgtacccaataaataatttttcaacccttactcccttcctgacctcttcccttttggggtccccagtctctgttacagaagaaagttttatagttactctttaacaaatcctgtttccaatgtgtgctttatagggtcaatgtaggcagatacttccagatcccagctgatgaaattcaggtcaaatagtattagtgaaagcactagctttaaacagtatttgaggttgaattattaaaatctgttacgatctgaggaaaaaactggggtcctcagggtaaatattttgattattgtgcaactctgttcatgttttaagtgaaatattttataatagcttattagagtgacgccccctagacacaatatggcaatcctgattgctggtcacatagttgggcaattattttaatctggaaatagacattgattattttgtactgctcattcaataatttatttctttattcaacatgtgttagttatctaacaggtcccattagcggtacaaaaatgaataatatgctgatgttgcaaatggcagaaatttttctttttaaacccattttttagggtttttaggctgactagtatttcattgtgtatatatatatatatatatatacaccacattttttaattcatttatctgttgatggatataacttggcttttgtaaataatgctgccatgaacatgagagtgcagttaaaattagctggaaaggtagccaggggtaggggtgattatcatatgataattctgtttttagttttgttgaggaacttccgtgaagttttctattaatgggtgtactaatttacatttccaccaagagtagcatataaagaacttctgtgaattttatccctaaaacaggataaaatgataaagcagagagaagacaattactttaaaaattatctgcatcaactctctcctttcaatgacttttaagtatgctagtttatttttttattaaatgtatattttcatatttttaaaagtcaaatagtacagcagagcttaaagtgaaaaaaagtgttttagtttttcatccttttattttcacctccatatctctaatatgaatatgtctttttaaaaagtaactacttttaaatgactatagacattatctcttaccttgtacatcttcttattccttcttttaatataattatctcactacattagctgcctcctgattattttagcatcaaataattcccttaatcacatacattttattttctgtatatcttgacttccaaattgggagtgagtgactttaatggccttcctcttcccaacaactttccctgcatctacctctcagacttcatcatctttctctttaattgtcattgtaaaagttgataacaaatatattttattgcataatgagtttttccatttgtctataggtggattcttaaggttgaaaatcaatgattgacatttgcatcgttatacctgtaagtagcgtgagctacgagtgaagacattgggctatgattacattttctccacataattccaagttgtaaaccctctgctacctaaagaagaacgttctatggattctgtcttacttctatttatttaaaatgaagtcacatgttagtttcatattttataccacagctttctttctcagttacttgtttccctctattggaaaaagtaatagttacttccttagctttttcctcattctacatattacttgaaatgtgttctatttttatttgagaagcctgtagacttttttttgctgcattttttcattattttaaaatgtataattatagaatacagtgtttctatcaactaccagaaagtctcaacacttcagtcttttccattttattggaagacatattctctttgtctcccagcttacaaaggatttcttttgttaaatcaaaattatattctgtaaaatttttatgtcacacatgtgttaaaactgtttcttatttaaatgtttcaagtaaactttctttcttagagcagtttttgattcactgcaaaattgagtgaaaatttttcatataccccctgccttttttaattttaaagagtacagcttgggatttgctctgggaaaataatactttattctgctagtgtaagcttaattttttagtctagtgtacagtaatagtgccattttctccactgttttgttttggatgctccagtaaagagtagctaaactctgtctagaatattctttataatttcagtaggttcaattaattgggttcaggtgacctaccagatagtttacatacattaaatataatattaaaatatctggatattaagcagtgttacttcagaaagctgagattaaaaagactatataaattgaagttgaactcaggtttctctaataacaaagttctctccactatttcaagctgcttctctacaacatattatataaacataaacagtgttaaagctgttaggaacaaaatgctaaataatctgaattttttagatgtcttttcttgtttaacagtgaatgtattgagaataaaagtaaataaatgatgtgaaattctcgataaattcacatcacaatcacttacctaatttcaaattatttatgcaaatgcctctgccttaaatcaaaacatgaaatgcaagacagtctgttgaaaaacagagttagctaaaaataaatgaaagaataatagattactcacattagtgtaaaactggtaatttaggccctttggcacatttttcagaaagtgccctttaaactttgttaattgcaaaataactagattgcccacctgccatcatgacagaggcttcttgttgcttttaattctggagaaggagggaaaagatgcagctggcccaccagtatttttggctgagattcaagctgacctgctctgctctgccctttgcagtttgttcatggagataaaacttcaccaaaatccaccctcaaagttaacagatttcatttgcagcaaggtacctgtggtatggtagcacccacatcaggacaggaatcagagatttgtgttcaaactaagatcctgacacctactatctgtatttgaacttcagttttatcagccaagggaagagaacattaacctttatcacagagttgttgtaaggagcagtgagctaacatatataaactgactttcccaaaatcaaattgttgtggagttgtatttattgcagttatagacatgtagtgaaccctatgcaactgaatgcccacagtgctccttattaatttgatatctactcctcctgatgagattccagttcctaggtcaagttgatttttaagtcagtcacatccttatatgttctacagcttggttatcttgtaatagcctcttgtattcttcaaagcaatcccccttatatatctaatattttgaaaattcagaatatgagccctgtataaaatatagagccttaaaatgttccaaaaatatctaaaattggagaattgtcactctgaaatgggaaagagaaatgcggatgtaattagaattctgagactcccaagagtcagccttagacaagtagagggagcagaacctatgctattagatctgtgaatgagttcagccctccacttactgctagtgtaactcaaggtaaatatggacctaactgctctgttttctgatctatgtatggaatggagcccataatagctacatcaatattttattgtgagtgctaaattagatcacatatataaaggtccttgtgtcctggcatatagctgactgtcaatattaatccccttttcattaatttttaaagactaacatttgtccttagtccccaaattttgcaaaagactttgaactttttatccttatcaataacttccccatggttgtataggataaaactgtaaatgtttttcataagtttacacattcacctgcgacaagactaaatcttaagcaaggatctcagtttttcaattaagaccaaaccataaattctcatgattataagtatataatatactgaatattatatataatataatactttataaaatatttatatggcaacatctatactatataaactacatgtattacttatatgtactatatctttaaatacaaaaatctcagtgggatgaaattgtcattaatgagaagtaaagggaagtgagatagaatgcaaaaaaatagcagataaatatttccatcagctcatatttagaataagagctattttgagtcataaaaggatgatgaattgcttacactttttatattattctctccatcacagtgaaaatataaatgatcaatgcatatataatgtggttcaattgtaatttgcccaaaataagcaattcggcaaaagagcaaaaaccaaaattcaggtcttcaggttgcaagtcccataccaatgactttcatgctcctaacacctgcattctgattatacccaattaatgcaacactctcatttcactatccctctgcttatctatgttttcacacaggcaactatggagaaagtgggatggaagccttcaaagatatgtcagcgaaggaagggatttgcatcgcccactcttacaaaatctacagtaatgcaggggagcagagctttgataagctgctgaagaagctcacaagtcacttgcccaaggcccgggtggtggcctgcttctgtgagggcatgacggtgagaggtctgctgatggccatgaggcgcctgggtctagcgggagaatttctgcttctgggcaggtgagtgataataagaaaatttacatggagttaataccaggaatttggcagcactgaagggtagcttttagtgtatgataaaaaattctttcaaagcttaatctgtgcagtggaaatagagcttaaatttcataacgcacctgtgcctggagaaaatcatggaaaataagtagatccgccatgtgctgattaatagtaacaggaatcaacaaatgaagatgatgcatctttaagtcctaaaaaccatgactgtaaggtaatgaaatggatttttatatgcttgagtaattcacttggaaagtaaacatgactcaaactcatagttgcttttaaagctgattttgagaatgactacatgagcttggtttataatgttgaatcatagaattttgggtttgaaaatgagggattgctttcagagcacatttttaaagcattagaaaattggcttgttattttatatcacaaaaatgtaggtgcctggtgacctacattgtttctagacaagataccaaaataccagcttctacagagattgactttaattatctggataattcacttgattgacacaactcagcacattccctgttgttgtggctgaatcagtgtattagtcaaattctccagagaaataaaaccaaaagtatatacatatataataaaaaatatgcatatatgtgtcctgcacacatatatatgtgtatgtataaatttgtgtgtgtgtgtatatacatatgtgtgtgtgtatatatatatatacacatatgatatttactacaaggaattggttcatgtgattaaagacccaagagagccaatatgtagtttcaatccaagtccaaaggtcttagaactatgaaagttgataatattaatttgcagtctgaaagttggtaggcttgcaattcaagatgagccaatgtttcagtccaagtctgaagactgaaaaagaccgatgtccatctcatgctatcaggcaaaaaacattacctcttagccttttaatactattcaggtcttcagttgattgtttgaagtccatccatattagagagggcaatctgctttactcagtctactgcttcaaatgttaatttcatccagaacactctcacagacacaggcagattaatgtctgttaaaatgtctgggcactcatagcccaggcactagacacataaaattaactatcataattagtaagacaacatcgtagttttgaatgtgtgaatgaggtgcacttctgagatggtaacactggaacttataagtggtagggaagctgcttcttcattgcatacctttaaaacattatgtaccatatatctttttattaacacgtagccagtgtaaagaacagcaaaaaccttagaatccactgcatctttctcaggatttctgccccaaatagagagccaagtcacttgttattaacttttgatggcttattaagggaaatgtacttccttcattttccaaatgcttaactgaccgtctgtgatcagacttagctccagctgggatacattttatgacagccattttatgtacccaattcttttctgtccgatctgatggcaatagattgatggggctattttggtatgaggccacacatccttcaataaaaatgatattgagtgagattccttttttatcaatgtcatatattttgtcaaaatcgtcgctagttggcaggaatgatgtaccagttagtttcatacaacccacgaacatgccaactgccaatattcttatactgtattctgaagtgcagtgttaccactgcagtaaaaataacagaaaagaaaaaaaatctagctttaagtagttctgtttttctgatagggaataaagaattccacgattcctatctgctccatttgccagcattaataagaaaaatcagcagcatttgttttcagtcatatggtgtatttgccaaaaagcaaatgttctttgatcccatgtacactaagtaaatagattggcttttataatatttgccattttccatgtatgattttatttccagaagcattgcaaaattttatattttgggtattttaaaatctattttgtatatgataaacatagagttctttccatatcatttaattcatggaatactaaatttatagcctctagttagattttttttatccccacattaactggctatttagtaatttgacatttacttgaacatcagttcatttcatttttgagcagttttgttaggtcttccttactccaaattttaaaactgtctccctgcagtttctgcctcttggcccatgtttttttttctttaaaagtaacgtgatgctctttcaaatatttgggaacaacagtgtggtcctcagtactctccaacttctctttgaaatatcctaacttcttccaactatcttagtgagatggcactgtgggtgttaataaaaccacttatcagaaccatttataggaccatttatcaaatactttgtgccaattactgtgctaagcactttacatgtattgtttcatttaatcattatttgacaaatgttgagtgtttactatatgtaaaagtgcttgaaataaatcaatgagcaaaaaaacaataattattgcccttatgatacttacagataagttagatagaaggtcatataagtgttatgaaaaaacccatatctaagaacaacctaaatattaagtactattctattttatacacaggagttctaagtaagactcaataaatattgatgtgtgaaatggaacagaaaagcaaaagttaatagtttgtaagaaaaagtttacatctactaactctaattttacaaatgaggaaactgatacctccaaaatttggatgacacaattacccaactaccataacttataatccagtgtacttttctactaacttgtcttctgtagagtagaaacagaggggaagttattatttgatagcaaaccctaggttctacatagaacctgagtttatttttttaaaattttagataattcaaatttttaattttaattagtattttatatcagtgctacctcctgaaaatttttatttagttcacgctataacttctttcagtattctagtgttattttgtttacagatattctgaaaatctctttgctccttctcttccccaattcaacttgaatgaatggctttaggaactagaagtcaaagctatgtggaaaaaaaaaaaggctatatttagagcctactagaaggtccacatttaatagctgtagttacttataaatatctccaactgccttaggtcaaccatgtttaataggtcgttcaacttaagtgcttggcaggactaagacaactctgctgctgagacaacctcatccatcagcacatctcaccatctgtgctgcacatcaatagaatgttagaatgatacacacctcaccactaggtctttccatttgagctgtgggtaatctgctgtctcattgccaataaaaatatcctgttcaggtccctgaaatagtcttgctaaacactttggctctgacagcaggctgagatcaataatctgaacagtaatggcatttcttaaggggcttattttctagaatgaatacactgtcttgttctagatctgggaaagaattacttgaaatacattatttaaaagttagaaatttaaataagacttggaaacaactagtttttagcaaattaacaactgaaaagatagtttcatttgatctataattaactttatttgaataatttgagaatattctttactacgatgattattacaaagccacaaaaaggaaatgtacttaaatttcaaaagtacttgaggattataagaagcatttcttagaggtcaatctacatcaatatttttcaaaatggaaatgataagaacttactgtaagaaatatccttgccaatgaaattacagtttttctagtcaaactatgatagtggctattccccagaggtagatattattctttatctttacatgtagcaagaatgtctattccaaattcagtcattttcaaacaagtatacaggcattccttggagaaaatgtgcgtttgatttcagaccaccacaataaaacagtatcacaataaaaatcacacaaatgttttgttttcccaattcatataaaaagtggggggggcgcggtggttcatgcctgtaatcccagcactttgggaggcagaggcgggtggatcatgaagtcaggagatcaagaccatcctggctaacacggtgaaaccccgtctctactaaaaatacaaaaaagtagccgggtgtcgcggcgtgcgcctgtagtcccagctactctggaggctgaggcaggagaatggcgcaaacccgggaggcagaggttgcagtgaactcagattgcgccactgtcctgcagcctgggcgacagagcgagactctgtctcaaaaaaaaaaaaaaaaagttatgtttatactgtactgtagcctaataagtgcacaatagaattatgtctaaaaatatataaatcttaattcaaatatactttattgctaaaaaaaaaaaaaggcaagtgatcatctgagccttcagtgggttagattctttttgctagttgagggtcttgcctcaatgttgatggctgctgactgattagggtggcaattgctgaaggtggcagtggctgtggcaatttcttaaaataagacaacaatgaagtttgccacatcaaatgagtcttcctttcacaaaaggaagtggtatttatctgtagcatgaaatgttgtttgatggcattttacccgcgttagaactgctcttaaaattggagtcagtcctttcaaattctatcactgctttatctactaagtttaggtaatattctaaattctttgttgtcatttcaacaatgcttatagcaacttcaccagagtatattccgcctcaagaaaccactttctttgctgatctataagaagcaattcctcatccatttaagatttatcatgagattgtaggagttcagtcccatctttgaactcactttctaattctagttctcctgctcttttcactacatcttcagttatttccttgactggaagtattggaacatctcaaagtcatccatgagggttggaatcacttcttccaaactcctgttgctgatatttttaccttctctcatgactcatgaatgttcttaatgacacctagaatggtgaatcctttccagaaggtttccaacttactttgcccatatccatctgagggattaccatctatgacagttatggctttatgaaatgtattttagaaataataagacatgaaagtcaaaattacttgttgattcatggctgaagaatggatattgtgttagcaggcatgtaaacaacactaaactccatgtatgtctccatcagacctcctggctggccgggcacattgtcaattattagcagtagtattttgaaaggatttttgtatatatatatatgtgtgtgtgtgtgtgtgtgtgtgtgtgtgtgtagtaattctgaaaagtagacttaaaatattcagtaaaccatgctttaaagagatgtgttgtcacccaggctttgtttttttcatttttggaacacagtaatacatgtaacataattcataagtttcctagtcttctcagaatggaaatgattgttggcttccacttcaagtcaccagttttattatctcctcatagaagagttagtctgtcctttgacaatctgaagcaaggccttgacttctcctctctagctgagaaagtgttagatggcatcttcttccaaaaaaaggctgttttgtctgcattgaaaatatgttgttgaaacttctctatcagtctgcacctgctgcttcacccagcactttgatgttacagagacagtttcctgtcttcaacctcatgaaataacctctgctagctttacacatcttctgtaacttcctcccctctctcagcctttataggattaaagagagttaagatcttgctcttgattagaattttggtttacaagaatgttgtggctgacttgatcttctatcaagaccatgaaaactttctccacatcagcaataaggctgtttctctttcttatcatttctctatattcacaacttggctgttttttgcaacaggcctaatttttggcctatatttgcttccaccttaccttcctcattaagtataatcatttctagcttttgatttaaagttagagacttacaattcttcctttcacttgagcatttagccattgtagggctattaattagcctaatttcaatactgttgtgtctctagggttagggaggcctgaggagagggagagagacggaagtacagccagtgggtaggacaatcagaacataccaccctcattacggtcttatataggcacagtttgtgatgccccaaaccaattacaacagtagcatgttcctaacacaaagaaataataaatgtctgaggtgacggatacgtttattaccctgatttgatccttatatattgtatacatttatggaaatatcacactgtatgccataaatgtgtacaattatcatgtaaattgaaataataatataagcgaaaaagatcgctgattacagatcaccataacagatataataataatgaaaaagtttgaaatattgtgagaattaacaaaattacacaaaatgagaccatgccattggaaaaatagtgccaacagatgtgtaggacagagttgccacaaaccttcaatttgtaaaaaatgcaatatctgtggagttacaataaaatcaagtgcaataaaaaggcatgtccataattttcttctactgggctattcagtgtcattaatttgtaatgtgggataaaagttaacaataggaatgatagtacctttactgaggtctttgggaaatgtcagatatgaagtaaagagcagatcatgagttcagttttggataagtggagttcaggtacatttcaaagataaagtagtctactaggtaggagaatatgtaagttgagagctcagaagagatatataggctgtaaatagaattgagagactcatcaggataatagcaaatcaaggacgtgtttgttaaaattaagagaggaattctaagaaattatctttgagggacctcagcatttaggttgaaaaaaaaagatgaactctaaattggagacaggaacaggcaaatccagagatgttgatgggaaaccaagagtgttgtgtcatccaagccaatggaagagagtatttacaggcaagaccaccagtgtcaactgaatttaggagatcaagtgaaaataacactgaaatggccatttggatttattgaggtggagagaattggcaatttaacaagacatggctgaatagagtaataaaagcagattaacaatgaagtagctaagaagtgagtagatggtgagtaaatgaacccatgacatataagccagtattttgggaagttgaactaataaggaatgaagaatgaaatctacagttcacccttgaacaacatgagtttgaactgtgcaggtctccatttacatatttttttcagttgataggttgaaatttatttttgagatttgcaataatttggacaaactcacacacaaaccatgttgactaggaatatttttttaaaaataagaaaatatgtgtgataaatgaatgtaatatttacatatactattttatcatttactaccataaaatctacaccaatctattataagaagttaaaatttatcaaaacttttgtgcacacttgtgagccattcctgattaagagaaaacaaagatttactattaaatcataactgcataaaattaactgcagtacatgttgtactactgtagtaatttcaaagccacctcctattgatattgcaatgatctcaagtattatgagtatctgcttaaatcacagtatgaggctaatcatctccctgtgaactgtgcatttcaccactaaatcacgcattacagtgaaaagtgattgttcctgattattgcacatttttttatcatgtcttttgcaatactgtgaaccttaaataacaccatgggaacaaaagtgtcagtagtgatgctgaaactgctcccaagaagaagagaaaagtcatgatatcacaagaaaaagttgagttgcttaatatgtactgtggattccggtctgcagctgcagatgcccttcatttcaagataaacaaatccagcataaggaaagaccaacataacgaaagaaaaggaaacgtatgaagccatccctgtggctacaccagcagatgtgaaaaccttgctcttctggggaaatacctttttctgtaattttgaaaatgcagcttttatgtaggtgtatgattgggtataagaaaggcatacatttagagtctaatattattcaagaaaaagcaaagtcattaaaggatgacttattcaaaaggaaggtgaaggatctaaagctggagaatttagtgttagcaaaggatggtttgataattttacaaagatatttggcttaaaaattgtcaagataatgagaaaaacagcttctgttgcccaagaagcagcagacaagttccaagacaccattaagaaaaccactgaggagaaggaatatttgctgtaacaggtttttaatgtgtgtcaaagtcctctattctgtacagaaaaataccacaaagaacatttattagtaaagaatagaagtgagctctaggatttaaggcaggaaggagtaagctaaccctcctgttttttgacaatacagtcaggtttattatgatcatgacttttcttatctacacagttgctaatcttctagcattgaagggaaaagataaacatcagctaccagtcttttggttgtacaagaagaagacctggacatttagagctattttccttgattgtttccatcggcactttgtccctgaattcatgaagtacctggctaggaaggactaccttataaagttcctttgctattgagcaatgcctcttaccgcccagaacctcatgagttcaacatggaaagtatctacttgcctccagacacaaagtctctaattcagcctctagattaggggtcataaggaccataaaggctcattacacacagtactctatggaaaggatcatcaactggttgaagaggatccaaatagagacaacatcatgaaagtctggaaaaattataccactgaagatacaattgttgttatggaaaaagccctgaaagccctcaagcctgatacaataaattcctgctgaagaaaactgtttccagatcttgtgtatcacttcacaatatttatgatagagccaatcaaggaaatcatgagatcatgggtatgggaaaaaaaaaggtgggggtaaagggtttcagaatatggatcttggagaaattcaagagctaacagacatcacactacaagaattaacagaagatgactttgatggagatgagtgcttttggaccagtgccagatgaggaggaagatgatgttgaagaagtagtaacagaaagcaaattgacattagataatctggcaggagggtttcagttattcaagactgcttttgacttcttttatgacatgatcctttctatgatacagggactgaaattaaagctaacagtggaagaaggattggtactgtatagaaacatttttagagaaatgaaaaaaaaaggcaaaaatgcatttccttaaatgtgttaagttaaactaagtgtgcctgcctctcctgcttccccttccacctcatctgcctcttccaccactgccacccctgaaacagcaagaccaaccccttcccttcctcttccccatcagcctacagtatgaagacaattaggatgaaaacctttatgatgatccacatctacttaatgaatagtaaatatatatttttcttccctatgattttcttgataacatttcttcctcttgcttactttattataagaatacagtatataatgcataccacatacaaaaatatgtgttaatcaactgattatgttatttgtaaggatttgggtcaacagtaggccattagtagttaagatttaggagagtcaaaagttatatatagatatttgactgtgtaacatgatgttgcatctaactcctgcattgttcaagggtcaactgtatattttaagggaaaatgaggtaaagagagattttttaacattaacattttatttctctccaaagatgtaatttataatcatgaaaaatagtttaagtggtgaacaaaatgtatagtgaaaagcacttgtatttctgtgtcaactcatggcattattaaatcatttgcactttgataatattatgaatgaaaatggcatcacaatgttttaatttgtagttttaaaattatgagtaagatagtaaatattatcttatgtcaatatttcctaaaagctacctatccatgtactaaaaccattttttgtttatttttccttattgatttctaaaaactttataaattaaggaaggtagctcattggaatatgttgaaaatatttttactcttgtcatttaatttgggctttatgatcttcagacaatgccaagcttcataatttttagatttttaaaattttatgatatatagtatctgtatcttgcatgcaaaggtcagttgtttatttaattggttaattttggtatccaggtaggataggtgatttaattaatgaaaagagggttacgaatagtataaaatgcataaaaatgtgggaaggggtggcatttaaagtccaggtggaggaaaccaactgagaagatgtactacagaactagaacagaaatttaaaaatgtgttggggcagatatagcttaaaagtttagaaatagaaaaatcacttgatggcctttcttcctaaatttggaggcaagtggagaaggaagtttgtgtgtgtatgtgtgtgtgtgtgtgtgtgtgtgtgtgtgtgtgtagcataaggggtgtggcagtgggttgagaaacagtcagtggagattggaaaccaggaaacctatactgttaataagtggtttcatttattatttttgaaaggtattactccatctgttataaacaatgaggagagaaagattttgttaaactataatgcaagatatttttaaagtaaggccaaatttaacatttgtaactgtagagtcacataaagtattatattaatttctcactgttagggatttaaaggttcattaaataatagccctttcctcaaattaaataccagcaagaagtcatggaattagtatatattagctaaatgaaaaccaaatctttgatctgtgaccaaatattcttctccatccccacagtcacagacaggactgaacaatcacaggacttgcttgctttaataggtagctttcagaaggacaacagaaaaactcaggttcagagaacagactgctccataaaaagaagagatggagtcgtacacacttaaccccttctccagtttcaccagacaggtgagtcactatccccagaagggatagtaggaagatagtggaatgaagctgtgtgttttctttccatgcttttctctcctggagcataaaagttcccctcaaacacccctattaaaatgtaaagaatgagatatttcttttatttctcacaagtcccttctgaagtgagtaatattaacctaactttatagatgaagaatctgaaactcagagacgttacttatatcttttttttttttttttttttttttttttgagatggagtctcgctctgtcacccaggctggagtgcagtggcgcgatctggtctcactgcaagctccgcctcccgggttcacgacattctcctgcctcagcctcccaagtagctgggactacaggcacccgccaccacgcctggctaatttttttgtatttttagtagaaacggggtttcaccgtgttagccaggatggtctccatctcctgacctcgtgatccacccgcctctgcctcccaaagtgctgggattacaggcgtgagccaccgcgcccggccgacgtaacttatgtctttaaaggcaactctgcttgctagatataagctgaaatgtaaataataccagttgacgtgggaggtgctgtaggtctgacaactgaaaatgaacaggggcttttgatgttattggatgaagaagtattcctatgtccaggatgaaaccaacccaggactttgaagccctcttctaatactagagcttgtgctttaaagtaatctgcatctcaaagtgcgctggtggctttgagattgattacactgcgaacatttgtttagataaatatttaaaacattttgataataatcactttttatagagtgatctttatttaacaagcactgttctaagtggttgatcttcatgtattaatttattgactttttatagcaattctatttgtaagctattattattaacttcattttatagctgaagaaactgagacacagagagacaactaatttgctcaaggtcccacaggcagtaaatggcagtgaggatattagaagataacctgtatcctaaaccattctggaaaaccatctctggatctttgataatcctcaatttcagtaataaattttgtccttacagtataagataatatgtttttctctattttcaagatagataatttaaacaaaggaaaatgtagagttaaaggtgattctgaaaatgtttcttttttaaaaaaaataagattaacaaaccaggagcaattacactttctgtaatcaagaaaatttaataattagatggactattcaaactgcacttccattttctcaggaaactaaactttttgatgaaactttagtttttagtaaacagaaaagtttgaagttgctttataaatgtgtgtaaacatctacagagaaacaaaggcaaactgaatattattctgtgctgaattccagtcaaaaacatttgctctttattgttttctagatttgtttttttgtttgtttgtttttgtttgtttttgttttttgttttttgttttgagacagaatctcactcactctatcacccaagctggagtgcagtggcggtatgtcaagtcactgcagtctctgtctcctgagttcaagcgattctccatccttagcctcccaagtagctgtgattacagacatgcaccaccatgcccagctaatttttgtatattttttattagagacaagcttttgccatcttggccacgttggtctcaaactcctgatttccagtgacctcatcttcccaaagtgctgagattacaggcataagccaccgcgcctggcctgttttctagaagattgacatgatttggtggaattaacagaagatgtgaactatcatacatatatatacacacacacacagatttatatacacacatatatacatatgtatatttctatttgttgacaggcattgtgataaatcatactaaaaacagtgactgattaactgaggcccatcagctgaattctatttttgtacgatagtttcactggaacatagtcgcattcattgacataatgtctatggctgctttggggctataatagcagaattgaacagttttaatagaagtcatatgtcccatagatccttaaatatttactatctgaccctttacaggagaggtttgcttcctgatccagagttttttcatctgtgaagatgaatatgcctacttacatagcagtattaagttttcaatattactcaaaagtagtcatggtttgcacataaactccactttttttttcaatccttcttgaggtttaagggcttctgatgggttatgagatcggagagtcttaggagtgttggttggagttgagggtacaggcttgaatgccgtgattctcagtggagaggagaaccagaacaaaggagctttttttgacttcaacatcctggaacataatgttcaaagcaattgcaacaggcaatgcatttgaactacctcctcattcaacccaaagtgatttaattttacctaaaataaaagaatgtgctaagtttaataagaaatgtactctttggatatagatattagtctttttaatacagttatttttacacctctcatttgctaaattgtatcaataacatggattaaaaatgcttcttttcttttttcctcatcccatcatccccagtttcctcagagttgttttttctgtaaaacaagtgtaattgtgtcatccttttgcaaaatgatcttagttgactcccctttgccatcatattccactccgtaatttggcatacactacatggcctaaaatctgccaatcacttcctatgatactcagaggtgagatttaaaatatgtaacaactagtaagatgtggatccaatcaaaacagatgcaagtcataaccaatgggttaatttatgctgatgcataccagccgaatatcagaattgacacacttctgcaccttcccactgctgtatcttcacctattctatctcaaaatgattacaattctctgaacatatctagcttacagtgtaacctacactgttttgtccctggaattacttccctgtcttttacctatatactcaggtttatgtatcaggtttatcatgtaagacatttccaggcagtttggaagatatcctgaactccagtaagacttccacagaccccttaaatatccctggaacttttcatttttatttttctgttttcttctttttcctcttacactagaatataagctccttgaaagtgtgggtaaaggtttataaatcttcatacctttcatacctaacacattgtagatattttagagtggctgaaactgcagggggggaaaaatggcagtaatagagaggcagaaaaacggttctcttcaactcagtcagcctaagtaaaaggcaggattctcataccctaaaatcgaaaaagtagactaaatatatgtttctctgcaagtaagccagctaaaagtctcctggtggagaacagaggtgactccctaggacaccctccccatgagtttatgacaggtctatttcatagcttttcttactgaatggtgaatttctggcctttgcaaatcacgtctaaagaaatgagcactttctatgaggcttaaacatgcattcaactaatcaatcacttggattaggaaaagtcaaattattagtaaagtggtgagacaaggaagaccagatacattcttggacacatgtgctgttttaaaggaagccttcgtaggttttatttcctttcaaaggcagggaaaatagatgtagtttcttcagtactctgacttcatattattagacttgccaggtgataaagtgaatattgattagatatcattcagtcattagttcagaatattttaaagctttattgttttctaatagcttagcaagtcatgaatacaagtctttatgcttcaagatgatttatagagattctctcaatttacctttttgtacatgccaaaatctgttttcttacttaattttactttaaaaaaatatttggcaatttttttacaaaaagtaattttttaaattgcttttgtcatggatacatatttgtacatatgtatggggtacacatgatttttttttacagtcagaatgagtaatgatcatgttagggttagggtatttacagtatccatcacctcacgtatttatcatttctatgtgttgggaacatatcaagttctctcttatagatattttagaacaaacaatatatttttgttaatgatagtctactcagctaacaaacattagaatgtttttcttctatctaattgtacaattgtttttacccattaaccaacctctcttatttacgccctacccatgtacacacccttctcagcctctggtatccacttccatgcgaaaaccttttttttggtcccacatatgtgagtgagaacatgtaatatttgtctttctgtgcctggcttatttaacttaacataatgaacaccagtttcatccatgttgctaaaaatgacatgatttcattatttgttatgcgctaatagtatttcattgtgtttacatataccacatttcttaacaattaatccattgatggatacttagatttatttcatatcttgcttttgtgaatagtgctgtaataaacatggaggtgcaaatgtctctttgacctactgatttccttttcttcagatacatacctagtattagaattgctgatcatacgatagttttattttttcttttttgagaaacctttatactgttttccatagtgtctgtataattttaccaatattgtctttcccttttctttgcattctggccagcatcttttattttttgtctttttaataatagccattctaactggggtgatgatacctcactgtggttttgacttacatttccctggtgcttattgatgtggagcattccttcatgtacctgtcggccatttatacgtctttgagaaatgtctgttcatgtcttttgcccactttttcatgcaattatttgtattttgggggggcagcgggagttagttttttttttaagctattaagttccttgtatatactaaatattactctcttgtcagatgaaacattgtgcaaatattttcttccattcaacaggttatctcttcactctgttgattatgttcttcactgtacagaagctttttggtttaaaacaatcccatttgtttatttttgtttttgttgtctgtgttttttaggtcttagctataaaatctttgcctagcccaatgtcctcaagtgtttcctctatgttttcttttagtagttttatagtttggggtcttactttgagtctttaatccatttaagatgtttttatatatcatgagagataggggtcctgtttctgtcttctgcatatggatatcaaatactcccagcactatttattgaaaaggatgttctttcctcattgaatattcttgacaacttttccaaaaatcatttggataaaaaacgcatggatttatttctgggttctctattctgttctgttggtctatgtaccatttttcctatcataccatattgttttggtcactatattcttgtaatatattttaaagtcaggtagtgtgatgtctccagctttgttgttattacttaggattgctttggtttttcaagctcttttttgattccatataaattttaagatttttttttctttttctgtgaagaatattattggtatttttaaaggaattacatggaatctgtagattgctttgagcagtatggtcattgtaacaatgttaattctttcaatctatgaatacgggatgtcttcatattcaattaagttctcttaaatttctttcatcagaattttgtagttttctttgtaaaggtcttttgcttccttggctaagtatacttatagatttttttaatagccattgtaattgggattgccttctttattttctcctcagccagttcattattggtgtatagaaatactactggtattttagttttaattttgcatcctgcaactttactaaatttattagatctaaaaggtttttggtatagtctttaaattcttctagatatgtaagatcatgtcatctacaaattagtatctgtggtattgattggatagggcactttggctctgagtgtgtgcagtagtgtagtttttgtatgatttctttgggtataggcagtgtcagtattgtctgtgatttccttagtagcttatggtacaattggtagtgaagtctgtagtgatgttttgctggagacaggaacatccactgagatagtcctcaggccccagtggtggcaatggcaggctaaatgtgcctgggtctcaccaagcacagcattcactggcaccaatgttaacgggctcaggctagctgattctttggcctccagacagcttgctcaggtgctggtagtggcagctttgcattgggcaggtaggtagatactcaggtccctgagcagtgggtgttgtgttggtgatgggagtagcagtggcagaacaatcctttggatcccaagcagtccaagctggtgttatcagtggctgcaatcgctggcccacagttggtgtgtgtggatagatgccagctgtggtggtagtggcaatttgggtgggctcatcctcagcaccatgagaggtggtggatggggcagagcgattgccaaactcccagatgccaagtgacatgttcaggcactgggtgagggatacttgaatggggtgtgactgtcatgaggtcccaaataggtacatgctgatgctggctgtggtaggcatgggctgaatgatgcccagattcctggcagaatgcttggttagggaggcagcggctgcactgtggccctgcttctgggaatggtggagttgctttcagtggcaaaagccataggcaggaggctgggagttcaagctttagccccaagtggtggctacaagtgagatagcctttcttcatggcacttttaaatgcatgatggccctgctacttgtggcagttggggttgctgccaatggcttgtacttggcattggccatagcatctgacagcagcatccatctgtgatcaggggatgtcagttttactccaggaataaggagattcaggatacagactggtggtgactgggctctcaaaatggtacctcactgtagttgtttagggcttgagatgtgtgcaggatccagcgtgatatggtttggctgtgtccccactcagaactcatcttgaattcccatgtgttgtgggagggcctcggtggggggtaattgaatcatgggggtcaggtctttcccatgctgttctcatgatgctaagtctcatgagatctggttactataatggggagctttcctgcacaagctctttctttgcctgctgccatccatgtgagacctgacttgctcttccttgcctaccttcgtgattgtgaggtctccccaggcacgtggaactgcaaagtccaattaaacctcttccttttgtaaattgcccagtcttgggtatgtctttatcagcagcataaaaacagacgaatacacagcgtgacctccctttcttgagccatgctgtcagagctgtcttcacgtagctctctctgttagtctcacagccagtgtgggtagaacggctctggcaagtattgcaggaatccgtggtggggatatggaccattaggggtcactcacttactctttccccacattgggaagtctctcctggctcctggcagagaaggatgcctcacttccctttcctttctgccttaggtgttttctgttacttctctgttgaatttcagcattctttctaaggcaatacattcaaagtgtgattatccatttgcttggagattttttacttttgtttttgttttgcggaggaggcaagtaccagataccttcagtcagccattttgaagcctctctctctcacttttattttaaatatattttaaatatattttatttaaatatatttttactatattgctataacagaatgtcagaagaatactttccaaaatccaatccccaaatcaaatctttgttttcatttgccttttcctctttgatgctttgcaatatgtccattcatcctttttaacatgtagcattaatataagtagacattatgctagtgcatatatattttttatttttccattatttgttttgttttcttctttccattatctcttttggtttttgtggttttgtttgtttgtttgtttttccttttgtctaccttctcctctcccttcttcctgtctcttcttactttctccccaggtaaccaatgtgaatatggacattctcttcctcacatttctctttggctttataatcattgacatacagatttcccctcaatatatactttggttctaggatattgattatgctaaatttgccgttttttgcttgtacataatcaaatacatatttaaaagttattttatagcttcttcactcctctttttgatccaaaaaatttctctgaaaactggcaaagttttgttttcttgttttgtacctttattcatttaatccaactacaattttttaaattaaaattggtgcattgcgaggtccttgagatagatgatcagatgtgcctgcatgatttagtaaataaagaattctttcccattgaaataacaacacttcttcatatttcattagaattatacatattttaaattatatattttctgtatactattatatcattttagatactctctttggtactattgttttatttatctttcttttgtagcagcatagtaggtggatgtttgtttgtttgtttttgagaccaagtctcactctgttgcccaggttggagtgcagtagcacaatctcagctcactgaaacctccacctcccagattcaagcaattctctcgcctcagcctccctagcagctgggattataggcatgtgcttccgcgacccaccaaattttgtatttttagtagagacagggttttgccacattggccaggctggtctcagactcctggcctcaaatgatctgcctgccttgtcctcccaaagcgttggaattataggcatgagccaccaagcatggccaacatagtgttttgattacattgtttttctattatacttaatacttgtaagtcatgccactctaattatttttagttttcgtatactaattttgtttttctcttaaatattgttggtctttaagaattttttaagatttttttctaattataaaattaagtttttaaatattaatatttagagggctgaaattttaatgatattaaatattctaataaaaaagagaagacatttaattcctatttttacattctgccataaagacagattgctttataaatattttgtgttttcttgaattattaccaccctttgtaatttcgttagtatatttttgatttccaactaattgttgctaataatgagaaaagccacttaatgtttgtataattcaaaattcttatttaatatttgtagttttctccagaagttttggattttaaacatgcacaataattttattaacacaaagtatctgagtcaatttatctccaatccttatactaatgatactattttcttgatttattacattcactaaaattttttaatcactggtgtataataattgtgataacaagtatccttttctttactttttatgggattggtttgttattttactatttagaaataacattttatatttttgtctttatcaatttacttattttcttcttcttatattgtcctgtcatgatcctgggtcctcatatctccagttccaagtaaacactttaaagaaaaatatatatatgcccaaattagaacaaataagattggatgagaattaggatcctaagttgtgaatgtacaattacctatatctcaaggaacacaaaacaattatatctggattctggtttagatggtaactaaagtatacgagtttatcttttttctcctctaacaatccatctaatttacttgccatttatttacagtaaaacccacagtcttacactatgttaccagattaacacatacctcttctgcctttctcatccatgtcctgttgctcctcccctgtcccaattcactttagccacagtggtgttcttgctgttcctagtctcacttccacctcagggcttttgcacttactgttctctttgcctgaaacaaccttcccccagatatcaacatcaatagatttgtcacgtaaaatcttcactcagatgttaccttctcactgaaacatctctgaccatcacatttaaacatgaaacataccctaccattgatagtctttaccccccacccactttatttttgtcaataatatgtattgccttataacatgtagcacatttgctacaaaatttcttatttatttggtttattgtctctctagtctatgctacaaggtaagctccatgaggaaagggattttgtttactgctctatcctatgtcactataaagaatacctggtacaaaataagcacctaatgaaataaataagctgaagaaaccttaatccatattttagcagataggattttttaaagtttctcatttagaatcctggaatcatctgagatcaaaatagcaggtctggaagaagcagcaggattcaaacaaccaaccaagtgagtagttttatgttctggtacaaaataagcacagtcagctgttcaaagagtgttagggtgaaatgaaaatggcgtaagcaggggaactagctgactcttcatttgtcctaaagcaaagtttacatagcaagaagagcataacatatttgtagaaaactaaaaactaaaagatctagaaatctccatgaaatatgaggtctagaaatctctgtgaaatatgagtatgcatgtaaggatgtgtgactagacatccagaaagatgaagtgtgctggaagattaagggaggaaaatgtaacattgctgatgtggagtagtgccagatgaggtcagtaggtgagggtgatgcaattacaggagaggtgaatggcactgcccttagcacattgattaaattacttacataggtcttgcatttgaagttatttacatagaggtttgtaaataactggcgttcagatgtcctcatttctcaagcaaaataaacacatttgtcatttgtacaaattgcttatttagccagagaagacggtgctgtttaaaaaaaatactccattacaaataaacctcttgcttcctacagtagaatcttgctctaatgatatgccaagaaactttcaagatgtatttacatttaatatgacatctcaagagattgttatagcctgacacttccacttttccatttttgaagtttctatagcaggctggattatgtagcaaaacaattgaaaaagttggtgattaccactcctatgggaaaattttattcctaaaagtctacatagtcttgtgatttttaagtagataaagggattttttttcagcttagaatttgttaccatgcattctgaggcaatatcataaccataacagtactaattccttatatttatttagtgctttaaagattacaaaatgctttttatgggcattatgccatttaatccttcttgtccagtacatatatgacagtcaccagtgacaatatgtccagatggtggaaaacggacatcagttacctaatacccattggactagtggctaccagatgctggtccattggcccttggaaggctttaatgaaattttcaaaggtccaaaataaaagaaaaataaataaataaaataattatatatataattatttgtacatacatgtgtgtctgtgtatttgtagttgataatggcctttattttaaaaatgatttttcatcactaattcctacagaacttagggtctaagaaaaacagcaaatatgtactaaatatttaatacttaattttggtaagtacaatgaagaaaccatcttttttattttggtaagtaaaatactctttcttgtattagatgacagtaatttatggtaatttgttttgcttaaaaattgctaaaactgaaaattgaactgtcaatactctgttggccttacattattttgacatcataatggtctctgcgaactaccattcaagacctcccgcatttgttcatatacctttaaggatattattctagaagaaaacacctcttaacaccagcttaacacctagagtgagattcatcattttcttttatataaaaataattacttcttcctacataacccagtgactgtccaaaaaaatataatgcattttatttcttacttagaacatggagtttggttaatgtttagagtaatgtttgggcatgccttgtgttaacaggtgaaatgaattaaggagaaatggaaatattaaagaaaacatgtagtgttatttgcactaaaacccaagccaccttaatttccttgagggttccttcagaaataggcaaacagtgataatctctcttgtggttagagccagtatttgccctaatttattttaattctaaaagctgtaatcatttgagtccagcttgtctttccactttcatattttgagagatttattcatatttaaaacataaagcagctctctagcattagttgcatcccacttgtgatttgtgttgtcaatttcttttacaagagacacccacactgtatgtcaaatatctattccctcatcttgataaaagtcatagaaaatgttgatttgctgatttaagacataactcatttctcaatataatgaagatggtagagtggcaagtaaggaaagtaaagactgtctctggtatttctgagcagattgggctaatgtaaatatagtacccctagaggaaaaactgaaggcaactgataatatggatgaaatagcaaaactgtttcaatcttatttgaggggtgttcacaaaaacaatatacatcaacaaagaaaaaattcagcagtacttaagaaaataacaaaccttaactcaaaaaaaaaaaagttcaggatccagtgtagttgattttatcctgttaactgaaataactgagatgatccttagcataagttaaatagccatcagataggtaataaaaataaagacttgcacatgaaaaactaaaaaaaagaaaacacggcagaccaaggcactaagaaatgtgcagggtacttagttgcaaacttcgtgcttagtgaagttttcacatgagctcataaatattaactcatctgtgttatatatctaaaattaaaacatgtttagatttataaatatgactatgcatgtagtatatgttactctgaaaatgaacatgcaatatgaaatatgactcataaaagatgatggtagttaagaaacctcagtttgccatatacatatgcatacccgtctacacacacacacatatccatatgtaggtactggtaaattatttagagcaggggtccccaaccgccaggccaagggccagtacaggtctgtggcctgttaggaaccaggcaacacagcaggaagtgagcagtgggcaagtgagcattctacttgaactgtgactcctgtcagatcagtggtagcattagattctcataggagcgtaaaacccctattattaactctagatgcaagaaatctaggttgcatactacttatgagaatgtaatgcctaataatctgaggtggaacagttttgccctgaaaccacccccctgccccgccccactgtcctgtggaaaaattgtcttccatgaaactggtccctggtgccagtaaagttggaggctactgatttacagctttctaaataagccacagtgcttgtgtacaggatggtggggaggagagcaattcatatagcgattccaaggaataaaagaatctttccatgtaatctagctctggtagttccttgtatgttcatcgaagactgctaatatcctcagtccttctcccccgccaccagaaaattctgtgaagtccacaaaagccaatcagaacaacttccaatactgacagcagattgaacactgacatttaatttcagggtttttttttcttaatgcttccaaatagaataaagaaacattgcccttaaatcttacaaagaccgaaggaatgcaagaagagatgatagcaacacaaattttaaaatggacaagtagtaactaaattacaaagaaagccaaattctcagccaaggagtaacccaatatgcagtatagaaccttccaaaagctcggaaatctgtgatagcagttacttctggaagatggaatgatcgtaggaccaaaagaagcaagaataataaaaagtttgtttaagcaataagcatccccagaatcctatctagttagccaaagagttgaaacgtatccagagtacagggtgaaaaagaggatctctggattgaaggtcccaacatcaggtgagaggcaaggcactatactgaaatgtggaaataagaaaacttttacaaactaaatgttgatagcccaagttctcttctccagttgggatcctagaatgcaggtagccagaagtttctctctatgcaggaaagtgggagtatctccttccctgagacccatgaaaccagctcaacatgggtgatcagccagagagcatcctagtcagtagtacttcctgatgtaaaatctacaatagacaggtcccactcacagacacagtctctagtctttttttttttgaaatcccctaacattaattatgaagagaccatttcacatcactagtacatctgaggaaaacttctaacactgaagacagagcacaaaaccagtaaacctaaaatattgaaggatatagaaactcttcagggaggtggaaagttaaagaactaataataatatccttaaacacaaaacaaaatatacagcatccttaaaagtggcaggaaatgcttccacaaaggaagcattttacattatttacattattataaataatgtaattataaataatatttacattattatattccacaaaggaatataataaggtcttaaaatgaaagcatatgtaacaaataaaacatctaatagaagggtatgaagaaacaaatcgaggaaatatctaaaaatgtaaaacaaaaaggcaaaggaatagaatagaggagagaaaacacaagaaaactggagaactgctctgggatttcccagcattagaataagaaaaacttgcaaaagaatagagaaaatgaattgaataaattattaaaatcatgttttaagaaaaatcctcagaactgaagaacatgaatttcaagattgaaattacccttttaattcctggatggttgaaaactattgagctgcgttttagtcacacttcaaaaaactggagagaaagaaaagatacctcaaatttccagagagaaattgggcgacaaaaggggagggagagaaggaggaagggagggaaggagagagagaaagagagagagaaagaatatggattgaaaggttgaaaagtttggcaagcaatgtcaccgagaagaaataaagacttaaagggaaagatgtaccacattcaggaaccggaagagtcaatattcttaagaagataattgtattccagccctgtgtgctgccacactttcacatcttttatcagctgaactgaatttgtttgagttcttaaaatatgccaagctcttctctgcctccgtatttgcacatgctattcttttaattggaatgatcttcttacagttttagctcagctaattcctactcatccatcaaatatcagtgtagatgtcacttcctcagtgaagtcttcccttgctacctaaaataacttcacctcttttgcatgattgcttattatcctgcatcttaaaatcattgcctttatgtaatttgtgattaaatattattcggcatttttatctatatatctcttattggcaagatcataagctcaactatgtatagcacagtggctataacacaataggtcaatatcaaagtatgcgtcatcctgtacagaaattattcatttaattaattctctttccaactaagatataaattccagaggacatatattatatctatttctttaccattgtattctcagtgtctggcacttggcagttgctcacaaaatatgtggtgtatgaagtcacttaaacgatttgatctaaacaataatctgggaaagtaatcatctcttctcaattcaaaaaataatgtataaaaacttccactgaaatgattttccatgaaagagtcatcaaaaagaattaagcataagccgcttcatgataaaatgtaagtaggaaattgggaactccagtattcaataattcattcttcaccaagaatgtattgagggcctagctcttgtctctcatctaacagggacaaatgagttcatggtgttcatgagttaagggtgtttttcaagttttaattttttgtggctagagaagactctggaaacataggttcaaaatttgaagtgatttattttccagactaaactttatcctgaaagcagtagaattatagaagatttcaagcagggggaattcaggagcaaattttgtatcgaaaggatcactccaggagtaatatggaagtgaatcaaaatgaaaatcagactagagcttgggaatatcaactgacctatcattgcaatagtccagagaagaactgctcaggattgaaagcaaagtagtattggagaaggaacagagaaactaaggatatggcttacaaatcatggaggaaggtgacatcgaaacctgagctgctctttgtctggggatggtctggaaatattttggaactatgacccttcctcctcctactttatgccccctgcttttttttttttcttttttcttttttttttttttttttggcccctcaagcaagtgttcaaagatgcagagaacaaaaaataagggagttacgatcaacccttttaatagaaaacaggaggccagtgaatggaataagcccaaattctctgctttcacttttctgtttttaatggtttgctctcagaaacttagaacagctctttcaaatagattctcaggacagatagttaattatcttcttatctatggccattttaacactgatgtagagccctttcgggaattcaactgaggtcattgattgttaccttggcttaaaaacttcctggcttcagtgatgtgtatctgtaggcaacaccctccatttgtatatatttctaaaatgatgtcttatacatcagaataaaaataatttttctttccttgtatgaggctatattttccagtgcccctaaagaaaatcactttcatcaggaataatttttgtgcttttgttcgcttatgcaaattttagaaaaactattttttagtactcactgtattttctacttgtattatatgtttaggaatccatgcctccaaaggacacacttagaaatacttcattctgtttcacagaggaaagtgagatgataacaaaacaagacatagagaggtaacatttggagttagacatttacgaaatattttgtatacattatttcctttaattttcatcacaaattaacaaattaaaaaatgttttctgcatttctatcagttagcaattcagtgctctgagaggcaaagctatttgcccaagattgcagggttaataactgtaaaagccaggttcatcatagtttttcaaattataaagtgcttttatctaatacttctctgcaaagaccagcaaaccagtgaacaccttatttcaaaaggtacagggctcgagaaagaatagcaataatggaaaaataatattactgatattactgattatattggcttttttttttttttttttttttgagatggagttttgctctgttgcccaggctggagtgctgtgatgccatctcagctcactgcaagttctgcctcccgggttcacaccattctcctgagtagcttggattacaggtgtgcgccaccaagcccagctaatttttttttttttgtattttttagtagagatggggtttcactgtgttacccagaatggtctcgatctcctgtcctcatgatctgcctgccttggcctcccaaagtgctgggattacaggcatgtacattggcttatttttaaaaattaatctgctatgatttgaatatgtcccccaaagttcatgtgtgggaaacttaatccccagtacaacagtgttgagagggaggactttaagaggtgattaggtcataagggctttgagctcatgaatagattaattatattataatggaagtgggttacttatggcaggagtgggcttctagtaaaaaagatgagttcagcccctttcctttctctctcgcacacatatttgctcgcctttttgtctgccaacatgggataaagcagcaagaaagtgcttgccagatatgggtccttgaaccttggactgcccagcctccagaactgtaagaaacaaatctgtgttcttattaaaccacccattttcaggtattctgttatagcaacacaaaattaactaagacgaagtccttaaaaaggaattaagtgagccacagtaacccacaaatatttgctaaagatgatttaagaaaaagtaaacttattttcatttttaacaagaattaatgacaaatcatgctattgccattaacaacatgaattctttcatttttgtttcaaaaaatgactattgagataacaaacttagcaagatatctgggaaaaatctgtgcagttattgtctaaggttatataaatatgtgagtttagatgaattaatagctacatgttaatttagactgattcattatttaaataatgtttattaatagcaactgaaaaatattcttcagtagcatatctactgcacaatctagacaaatatgtaaatatatatagtcattttcagttgataaagtatcttcatattttgatacattttctctgcttcagaggagaaagctggagttcacagtgttatgtgatgtggtcaaggtcacaagctcagaaattatggcatcaagcctcaaacctatttattttgattccaagacctatgctctttccactctattaggactgcctctctctctttggaagcattcttgttagtgatttgtatgaagtcttgaaaatgttgcttttgaaatttgtccttcacctagagctggaagtttaaaccaatgtgactaattatagaataagaattggaaggaaaaaaatcctttctgatggaaaaactggacatattctagaaagttgaaatttatcaaggacaaatgtaaactctcataatagattcaattaatggattcaatgactttgggggttctgtccaaccataacaactttttgagtctatacaataatgctgtctttttttaatttccctttgcataaaattgaaatctgcatttacttttagtgtcttctgctgatttcattgaatatttatataaactgtgatttagagacatatgtttattagtcagctttgttgtgcaaatgaactactttattagagctactttcagaataataatttgaatgacaggcatgaataatgccttctgcaaatataataaatatattggtctactatcacttgcaaagcaataatttctatgtaataagtgtttaaaaataataagaaaattatacaagtatcaaagcagtcctacatttataaatctaatcttgctactagaaagaacatgacttattcacatcttgaagatgtattcatcattctgcttctccaagtttactgaataaaataatttttcttatttttatggagccaaaagtcagcatatcatcatgtatatagttttaagatacaggttgggtaatacttttgtacagaatggaggcatttgaggaatgtcacaggctgattatttttctgtcataatcatgatacaacatattgctgaataaagccagcaataatggtggcaagtaaaccaaatgtggtgtcccaactaagacatataaaatttcatctgtcctccaaggcattataaaaatcaagctttcatagatcctttagccagttcattcatttttattttttctttttttataatagaggtagatttatagttttttatgtttatattttataaactatcttttcataccaaaaaggaactgaggtttagattagtttaagtaatgaaaatgttagcaatcaactttctcagcatgtaataagcattctgtgagtacttactgcttctaagttacaatgactatagaaatgaaagaaacagacttagggaagcagtgtaacatgttggctaaaaatatagacttcaaagtttaacagagctcgttcagttcttaacactgtggattatcagcatgagatctcagccaagttacttaatttatttaaacctcatttttcttatgcataatgattattataaattaatctcacatttttgtaggaaacagaaaagatatttaaaggacttagtacctggctaccacaatgttagcatccaataatttaataaataactcagtgttattatatttccctcaaggagcattcagtttgttttctaacacattcagagtgattttgaatttttgtatgttgattggttggtaggtaataaaaataccttacactagttgatggtatttttataaacattagtcaaagaaattagaaatcaatgcaaaaatttaagtatggttaaatattaacactttttgagttgatatcacatgatgacatgaaactggaaaataatttttcagggtttgggaattgtatcaagtacagctgaaaattggataggtccacaagttcaaacaaagaagtctggtggaaaaataatcaatagaaaaaaaaagagaaatttaaattctgtggtatctaatattagaatttcctaaatcaaaagagcattttatgtactgtttacgtgtaaacagtggcaaaataagcaaacgtatccaaaattatttgtgtaaaatatccatatgtgtttctactaaaaaattccaaaccaatttgaagatattttaccactaatcaactatatgagccaaattttgttctcttcatggagtgatattttggttctttagtttaattatgtatttaataaaccaatctcaaattattaaaataaactcaacaataaaatttgaagttttttgcttgttcatttgtttggtaaaaaggtacacattgatttttcaaatttatgtagatagatagacagaccgacagacagatagatagatctgttagagttatctgtttcttccagaattaattatgaaggaacttttctattttatttaaattgtcaaaattgtgggcataaaattgtttacactgtttttttatgatccatttaatattatataatttgtagcaatataacttctctaaaaactcatattggttattcgtgccttttctttcctttttttttttttttggaccaatctggatagagatttatcagttttattgatttttctcaaataactagcttttttgattcactgattttttaaattgtttttctgtgttctctttcattgattttttgctttgatttttatttgctattttctgcttatttttatcttcatttgttctgtttccaatttctttttcttttcttttcttttttttttttttttgagatggagtcttgctctgttgcccacgctggagtgcagtggcatgatctcggctcaccacaacctctgcctcccaggttcaagtaattctcctgccttagcctcctgagtagctgggactacaggcacgtgccaccatgtctggctaatttttgtatttttagtagagatggggcttcactatgttggccaggctggtctcaaattcctaatctcatgatccacctgcctaggcctcccagagtgctgggattacaggcatgagccactgcacccagcctgtttccaatttcttttttttttttttttttttttgagacggagtctcgctctgtcgcccaggccggactgcggactgcagtggcgcaatctcggctcactgcaagctccgcctcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggcctctgtttccaatttcttaaggcaggggctgaagcctctgatttgtgacctttttctctggtttgcatgcttgtcccccaaacatttaatgttgaaatttgatttcaatgttggaggtggggcctaatgacaggtatgtgggtatgggaaccgattcctcatgaatagattaatgcccactgtcagagatgagtgagttctcactctgttagttcccacaagcagtggttgttaaaaagaggctaacacctcgcctctttctttgtttcctctatcaccttgtgatctctgcacatacaagcttcccttctgttattttccacaataagtgaaatcagcctgagactctgaccagatgcagatgaccaatcttgaaccttctatacatcaaaattatgggccaaattaagctttttgctttataaactacccagtctctggtattctgttatagcaacacaaactcaattaagaaccttctttcttttctaatatagcatataatgccctaaattgataactcacaaattttaatatgttgtgttttatttgtatatacttcaaaatatcttctgattttcattttgatttttgtccttgacacatgagttattataaatgttttatttagttcccaaatattgaagatttttcagatatccttctggtactgatatataatttaattctattgtggtcaaaagtatactttgtatgacttgaattgttttaaatttattaaagcttgatttatggcttagaatatggtccatattggtaagtgttttgtgtgtccttgaaaataatgtatatgctgccattgtttggtggaatattctataaatttcagttagcccttgttgagtgatgggttgttcaagtctactatattcttatttttcagttgacttgttttgtcaagttattgagagagggacatttaaattatgactgtgcttgtgaattctttttatttttacagtttcattcatttttgctttatgtattttacagacctattattaggtgcttacatgattaggattattctactacttaatgaattgacactttgatccatggtaatgtttatttcaattctgggaaagtttcaattacttgttattttttttcattattggttgtttttttcccactattctgtatgcctgatagcttgtttaaattgcaattcagatattgtaaattttacttttgtgattgttgtattctttttatctttataaatctcttcaattttgttctgggatgcagttcagttagttggaagcagcttgttctttactgctactattttataatttgttaggtaggactacagctgtgtttagtatatatatagaaatattctccactgcagaggcaatagtcttctgagtattctactgtgtctgtgaattataagacttcctacttagatttatgggtacaggcactattccaggtcttctgtgtatcctgagtactgttcaattcaatactttcagactgtatgttttgcaggctgtaatggctaactcacattcaggtactgataaattatttgctaaatacccaaaaaaggccctctgtggattgtcagagtcctcttctctagtcctctatcttgtagatgttagaagcctttgtgtcctcagactcctgttgcaatggcctggaaattcccttgtggctatgggctagggcaattgtagggttcatcttgtttgtttctcatttctcagggattactctcctacattgttcaatattgtatttcttgaaaactattgttttgtatatcttgtccagttttttaattgtttcacataggatggtatatctgatttctgttaaaacattatggtcagaagtcagagtccaatagtattaattttggaatcatttagtaattaaaagtactattacatccaataagcaactggaatttagaaggctaagtcttgtttttttttatcttttgaattaatggttaatcagggaaagtattattgtaaaaatttttaggatatataggtggagtcaaatgagatgaaataaaaagataatatttcttttataaaacgttatgagccactttattcagtattgtatattcctacccaagcctgaaattctccagatgattcaacattttatatgaatctttatatgttatatgtaaaaatatatgcatactcatctgtgtatctactttgcttaatttctagagatactatggatcagtacaaaaggttcatagtctgtttcactttctcatgaaactgtttcactttctcatgaaactgttgtgatataaaactggggctttttgagatatgtttagaaaacttgcactggaagaagctgggaaaactagaagtcattccactaacatgagccccaaaatgtttcaagcatatgacagaattttcattggcattctttttttaaatgagttatagaaaattgaagtaaagtagatggtggtagaataagtcacactcaggctgactctgaagtggtactcaaggaatactgattgaaacatcttggcaaacctagtgagagaactaaaaaatccccagcctggggtgctcccctttgtgctgttccattaatcattcatgcacttagcagacagcatttagtaccccctacctgcaagtcacagggatacaaacgtgaataaaatgtcagcaacttgttggaagactaaaagacggtatttaaaagatttatttgtgatacaaacctggtaagaatcagcagtttcttttgcaagaaatctaaattttggaggacattagaatactaaagcaatgtactgaaatgcacaaagagaaaatattaaaatgagataaatactaatcttccccggagttaaaacaaaaatcaaatataaatatatgaaattcaggatgagtgatagggaggtaagacagaaagataaggatttaccagaattcaggtgagaaaagctgtaaaatatgaatgaaacaagcatagacagagattgagaggcctttttttaagtaattttctagctgtgaaaactatgttcaaaacatttaaaatatttgtttctatttccctacatgcaaaattggatgtttagtattctagcttcaaaaagagtattttaattcttggagctcaaagttttctgtgttaaaacctgggttttgggaaaaaaatgaaatttcgtcttttatgatgaaaggttttcataggtgtctttgcattttattgtaatacactttaaggcagagaggcagtgtcagccatattaacatcaacagtaagagtttgttgattgaaaaatatttttgtctcttccacttactgaacaatgcagaacaaataacatctccttgtcttagttgctttatctctataacaaatgcattagaaaaaaattaagtcaaaagacctggttcagaaccatctcttccatttcttgggcaatcctaagcaaataatttaacatttccaggtcttaattgctttatctctatgataaatgtgttagacaagatcctctccagttggaacattctataattctaagattcttattcagacataactgagcatctctcacaaatatggtttttgcagttgacgtatcacatataattatctcaatttttgggggcctcttcagagcctcatcactaaaatgacttttcctgatgagctaacttcaatatatgtgaatattgggacaatttctcttggatatttatgaaattatcgaaatatagtatttactttggcagcaaatggttaatattgaatgtaggttatcatttcaatattgtacccttcagacttataaaacagaacttccgaagcaagggaaattaacttcaccttccttttgtaaccacttgaaggcagaaacattaacaatatcaccaaagtggcccaaagtgtactcgtttaatatgagtcttacataactgacctaattctaccctctacgctgcagagaaaagccttttttgggaagagtatgtcatttctggctgttatcactgataggtgctgtaaatttgtaccactgagctctgggtaagttggcgcatggtacccctggaagaggatatgcattggatctggaaggggcagggtgtgattggagagggaaggaaatcaccatatattgtgtgcctgtggtatgctttatgtaagatatctcacttaatacataaaacagtacataattttgtatcattacttctcatcttgtcatacatatagtttgtcctataggtattaaattatagagaccgttctccctaattttgagaattcattctactttcattctacagagtgagcccaatctgcaaaaatgctctaaggctgatatcagaccaaaaagcaaatgttcttctctacttctaagagagacctgctggaatattttcttctttctgtatctaaaagaacccagggtcataatttttctacagcacagaatagtagagaatactgtggattctacaacaggtctttgttataaaatattcaaactgagtttctgtttcctggttcagattcccaaagtccttgtttccttatattttagatttcatatcccgcttttaatgctctgtatcttttttctccaaactgtcacaaagtctatcaaaatgtgttcagaatgttttccaaaaaaaatcttctgttatttgtcctcaaaggcaccagcttagtctctgtcctgctggaaacacgtatttgaatacttgaattgttgtccttctaagtgatccaccccccagtgttgttaaggcatagcatcttgagaatggaaaaaaaacaaaaaaaggtgtttctagaataatggcttttccataggagggaacttagaatattagagctgagataatctttgcccaaaacttatctaatagaatctttatactttttctctgagatagtcttgttcccgttttacagatgaataaactctgttaacttgttaatagcacaaccagatttcctaattccagttctgtttctcttaagttgtgacatagttttttgaactctttgagcacaaggagactatctgccaatattgacttcctctttggacatagatggcaataaatagattaaacaaaactcttttttattcaatgatcctggttggcattggtcatcttcatactgacatacatatttatacttcacaattaatttaacttggaatatttaatatgataaaatatcaatgactgacacaaatacagcttctcagtaaaagctgtttcccttcctcctatgctgcatgtttgtaggagcaacgaacaggattcattctgcctgttgatgccttcttcaggatgcttactctaacagctccctgaccgatcttcagtatctactctcttcctaatttaatccctgtcttgctgggccccaccataccttgctaatcttatatatgagcatttacttttttctcagctgtttcttcatgtaatatttgtgtagctacagatgtttgtacagaattgatatttgaaaaggactcattcccatgttttatttttactaatgccaccagagactaatcctcttttattcctcttcatatactcatttttcaagagccagcccaagtttttttaaccaaagctttactcagctatccaaacctaattattactggcttttatggatctcagtgttactgccatacatagcacccttccattatctcaaacttgctaatctaggctgcagtttttccaaaccattttactcttcagtctttctcatacttggggcctaatctccaataatgaaagtcatcatattagatgcataatcaaagcacagaggtcctactgtaacagctttcccagttcctgtcctcagtagtagaggcctctctagcctttatttcttataaaggaaagtccctgagtagggcagttagataaaatacaagacacacaattaaattcaaatatcaggtttaagaaacacatttgtttagtatcagctatccctaagattgcatgggatatatttatgctaaattaactagttttctaaaattcaaatttaacagatatttgatatttttatttgctaaatctggcaaccatattcctgaagaatctcctcaacttttttttttttgacatattaactgcattatacctggtctcagttcatcttgattgaatgtccctatatgatgtcatatcttacatgtctttaatgctgccttgttttcaaagtacatatattattttatttctttccccaaattgcccaagtgtatgtttattatctttaccagtcattaacttggttgtttaatatcactgggtttccattttctagaatatagcaaagttaatcatgcctactttgatgaacagtaaaaataataatctttacaaagattaaatgagatgaactacataaagcaaagtgcctggctgaccaaaggaaacaaatgaccaaatgaatctatataacctctacactcctctgccaccatcctaattggcttgcttaagattgaaaagccaatatatgatgaagctgagagcttaaacttgaataaactggctacagttaagagcttattagaataagcctctaacttgccccttagaggggaaagaagtctgatgaaacataagaaaatacagtgacttatcacctcctctcctccagctggatatttccctctctccacgatgagattatttttcaattaattcctcccttataagaaatatatgagataatgctttgttcttaatttgaatcagttgctctatgctttttctcagtaacttgtgaattaaaaaagaaataaaatgcttttaaagagtctaaggttaaactaattaacagtctccaaacagaaacaaacacgttgttaaaagataaaggaagtggattgttagattctgtctattcttccccatggatatacaaggatgttaattagtggaacatggatgccgataaatgccaaacaattatttctcataaatctttgtgaaatgtgaaaaataaaaatatatcctgggaagcagaattaattcatgttaagggatcatatttcgaggtacattattagtattcatgaacatggaacgagcagaattcagagatttctgccaagccaggagttcatctaggaagactaagagattgaaaaagagaagctgttaaggtagctaattttgatgccatttttattatctttcttgcaataatattttacattccaatataacatgatgacactgagaagtgtcatatgttatggtcactatgttacaatgtggctttgagaaattctcacctcttaataatgtctgtggaaatatactttttcacttcactaaagtggtttttcacaaatccatgctatttaactataaagatccatgccattctctgcttatctgttcctgtatagtggaaacattaaaaatgataatctaaatgcaaacacattgtttaatattctttctatttatttatctgaccatctgtaaattattttaactatacagtttacatggtaaatacataccctgcatgctgcaactaaaattctatggctgtaaagtacatatatacagtatctaaggacagccagattttcttatatcttgctattagagattagaaaataaagtcatttcaaaacttatattctagtggaaaattcaaatatgagatagcaagtaacaaggcttaaatacacatgtctgtgcattccatatatatactatgtaaaatgtctcttctataaataattgccagtatgtaatatatataccatcacatacacaattattgaatagtagatattatatagtaatcagtaaacaccctattatagattaaccagtatctagaaatttataaatgaatattctatgaaaacatatgctataaaatgtctaatatgcctattttggggattaaaattattctataaatgataacaaatactgagaaagaaatgttctaaagtgttataaaaactacatggcaaatgagaagcagcttgttaattgactaatacgtataactcagtttctcttagcacatttttattcaaattgtataaaatatgttatttgaattttgcaattcattaatttcagatgcctaaaaaaaagtagtttatatgaagaaaatctgcctgcactctgttttttgaaacactaaatgcaatttgaatatcagatctctcttttggtgacagacttgcttaacagactgattaccaatgataacttgtagttagaaggtttctcaaaaagatggcataccatcaattgctcgactcacagggcccagcagtaagtgcttaccaagtgggtccttttcttattctcccactgacaccaatctagtttcaatcttaattgcttcccatttgagcaaaagtctcctaaccagtttctctttttcttttctcttcagattttaaaataacactcctattgtagataggataagctttctaaaataaaataaagtgacaagattttattgaatggacattacaggctagggacagagttgagtctagtataggtttgtaggtagggtacaaattcagtaatatgcttcatttgagaggattccaaagatcccctttctaaggttgcctgaaggtttaagacagcttttaaacattttttgaaattctgacattttccacccattcatgtgttcagtaagcattttttaaaactgtctatgtcaaggtttatggcagaaaatgcagatatagaggtaaaaaggcaatgcctttaccattaagagatgtagagtccagtgagaaatccatgtcaacagataatttgtacaacataaaataaaatgcaaatacagcctagggaaagtaaaactttgttttgcctgggcaagttagggaagacttcacagaagaagcaatatttgaatcaagtcttaaaagaagataatcattgtcttgaagttctcttttaaaatttaagcaatatcttacagtttaggggtaaagaaatgaagatgtggagaggtaacaatactatctggggatcaattagtgtattagaaccttaacacattgaaagaatacaagtataaaaagatggggaaagtttcacaggataccaaaaaaaatcctaaaatactgtatgcccacatgattcccaggatgagggtgttgaagggaataaaaagcaccagagatgagcttgatctactccataattaggtataaatctagccccatgtaaagtaacctcagtattgtcagccacagagctatcctctctagcattagtcaattcttgaaagctagttattttcacagttgagatcaactgcctaaaatattctatattactttcttgcctctagaacttgattaactataggcagaaaccaaaggaattcgaactcatttgttaataattaaattgaccattaaaattgatgattaatggaataattaaaatgaattaagtcaatgttgaaacatctagtgtatttcttccagaggatttaaaataaaaagaacacaccatatctttaataaattcttgcaaataaatgattgagaattcctggaatttctgaaactacagactgtgaaatttatggatcattttagaaaaacagacattttcttgctctcctcctccctgtggacctactgaatcagaatctctttgtatgaatcttggcttgtgtatgtttaatagaggtccatagatgattttggtgagcacttctagttaagaatcacaaagttttttctttacattgtgcagatgagaaaactgaggtccaaagggatgaagcaaattgttcaatgccatgccactagtagatgcagaattgggatttgaattattatcttcctttccagtgctattggcagcacttgacagctgcctctggaagagtctgaccctagagatctggggcagagtatcaaagctagttatagaaatagaagccttgatcagaaatttaatatgtcagtgtcaaggaaaaaaataaagggaagattcctacacccaaaagttcaggtaattgtcaattaggggaaaaacgtcagagagatatatttattcatgagattgatgggttcccttactgagaaaacattattgagtatatattatgtgctaatcactgagaacaaaaggaaggagaagacaaaacattaaccataagacatactctctaagtctttagaatttttaaaggaatgcttgattagaagagtgaagattcatagtcaaatcaataccgttccatttgcattgaaatttctttttgctttgtattagtaaagctatgaagatggttaaactgctctatttttttggaaaccaacatttaacatattaaaaatcaatattttctgtttttaataagtatatgggccgtgcgtggtggctcacacctgtaatcccagcagtttgggaggccaaggcgggtggatcacaaggtcaagagattgagaccatcctggccaacatggtgaaactccatctctactaaaaatacaaaaattagccgggcgtggtggcgcatgcctgtaatctcagctacacaggaggctgaggcaggagaatcacttgaatccgggaggcggaggttgcagtgagccgagattacgccactgcactccagcctggcaacagagtgagactctgtctcaaaataaataaataaataaaataaattaaaataagtatatggagaaatatcagcactcatgagttgatgcatgtgaaagttgatacaacagaaactctggctccaggtctttaacaaactgcctgctagggttgcaacaatccctccaacacatgcatttacaggaaatagtctgtacaaaaatcactgaatttattacaatcaagcttttggcataagacttctctttctttagttttttaatttgttcaatttaaaggatataagtgcatttttacatggatatattgtgtagtgaagtctgggcttttagtgtaactatcacctaataaggtacattgtacccattaagtaatttctcatccctcatcctctgccaccctcctatgtttctgaatctccaatatctattattccccactgtatgtccatgtgtacatgccatttagctcccacttacaagtgagaacctgcagtatttgttttgtttgtttgtttttgtttttttattttattttattattattatactttaagttttagggtacatgtgcacaatgtgcaggctagttacatatgtatacatgtgccatgctggtgtgctgcacccattaactcgtcatttagcattaggtatatctcctaaagctatccctccccgctcccgccaccccacaacagtccccagagtgtgatgttccccttcctgtgtccatgtgttctcattgttcaattccaacctatgagtgagaatatgcggtgtttggttttttgttcttgtgatagtttactgagaatgatgatttccagtttcatccatgtccctacaaaggacatgaactcatcattttttatggctgcatagtattccatggtgtatatgtgccacattttcttaatccagtctatcattgttggacatttgggttggttccaagtctttgctattgtgagtaatgccgcaataaacatacgtgtgcatgtgtctttatagcagcatgatttatagtcctttgggtatatacccagtaatgggatggctgggtcaaatggtatttctagttctagatccccgaggaatcgccacactgacttccacaagggttgaactagtttatagtcccactaacagtgtaaaagtgttcctatttctccacatcctctccagcacctgttgtttcctgactttttaatgattgccattctaactggtgtgagatcgtatctcattgtggttttgatttgcatttctctgatggacagtgatggtgagcattttttcatgtggtttttggctgcataaatgtcttcttttgagaagtatctgttcatgtccttcgcccacttttcgatggggttgtttgtttttttcttgtaaatttgtttgagttcattgtagcttctggatattagccctttgtcagatgagtaggttgcgaaaattttctcccattttgtatgttgcctgttcactctgatggtagtttcttttgctgtgtagaagctctttagtttaattagatcccatttgtcaattttggcttctgttgccattgtttttggtgttttagacatgaagtccttgcccatgcctatgtcctgaatggtaatacctaggttttcttctaggttgttatggttttaggtccaacgtttaagtctttaatccatcttgaattaatttttgtataaggtgtaaggaagggatccagtttcagctttctacatatggctagccagttttcccagcaccatttattaaatagggaatcctttccccattgcttgtttttctcaagtttgtcaaagatcagatagttgtagatatgcggtgttatttctgagggctctgttctgttccattgatctatatctctgttttggtaccagtaccatgctgttttggttactgtagccttgtagtatactttgaagtcaggtagcgtgatgcctccagctttgttcttttggcttaggattgacttggtgatgcaggctcttttttggttccatatgaactttaaagtagttttttccaattctgtgaagaaagtcattggtagcttgatggggatggcattgaatctataaattaccttgggcagtatggccattttcatgatattgattcttcctacccatgagcatggaatgttcttccatttgtttgtatcctcttttatttcattgagcagtggtttgtagttctccttgaagaggtccttcatgtcccttgtaagttggattcctaggtagtttattctctttgaagcaattgtgaatgagagttcactcatgatttggctctctgtttgtctgttattggtgtataagaatgcttgtgatttttgtatattgattttgtatcctgagaatttgctgaagttgcttatcagcttaaggagattttgggctgagacgatggggttttctagatatacaatcatgtcatctgcaaacagggacaatttgacttcctcttttcctaattgaataccctttatttccttctcctgcctaattgccctggccagaacttccaacactatgttgaataggagtggtgagagagggcatccttgtcttgtgccagttttcaaagggaatgcttccaatttttgcccattcagtatgatattggctgtgagtttgtcatagatagctcttattattttgggatatgtcccatcaatacctaatttattgagagtttttagcatgaagggttgttgaattttgtcaaacgccttttctgcatctattgactttctgtttctgagttgtttcatttattataatgacctctagtttcattcatgtttctgcaaaagacatgattttattctttcaatggcagaatactatgtatacactataaatagtatatatacattttctttattcaattatctgttgatggatacttaggttgattctatgtctttgctatgtagaacttctgatttttgtgagctgagctggatctcagagtcttaaagcctacaccagaagaagtgtttttcttagttctttgtctttatgaccctactctttaatgttgatccatgagctctcatcactgtcactgcaagatttgaaagcaagcataaaatcaaagaaacccaggaaaaatagaacctcgcttcctgaaacttaaaagagatattctaaagcatttctccacatttccctcccccacgcttgtttctgcttggtgcagagaaggggtttcctgcagcttaggaatattcctgacccttattgcatcatccacatgggtgtaaccagaaaagggttaacctctgctcagcatactaaattctctggctcctgacaccatgaggagcttttctcctcatagaggttataaaatttgttaatgtataactagtaaatagcaggactagaattgaaattcaaacttaattggagaaatgtgtgcctttgaagcaaatgtgcctttcatttgactatacttactatctctgtgaaagaagtcaagttattctagcatgtgggtttctcacctatgcctgactctcaactatgcctcccacattgtcctcttaatacactcttttaactcatacaatttatgtttgtgggttttgttaagattcagttgttccttaatttgatgctaataacccttgcatggatgattgtttacaagtagatatatttgtctcaaataactaaattgttctgtgcagttctagcagactgctggcaatatggaatttaacatttacaatgtctcctatactagaagaaacccagaagcatgaaccatgttaggctggtgcaaattacctttgagggtgcctctcaaaaagtaattacattacttttaatggcaaaactgcaattacttttgcaccaacttaacagtaatttatagcttcagtgagacacaaataaaaatctcacatctggagacatataggaacaaatcctttggccagcttctcagtatctacatggcaatgtgcttttcttattccctaccagcaattatttatacattttaggagaaaattttggaacttaaaatctctacaagtttatggaatccctaaatctgtggatgcatcactcaaaagtcaaaggcttaatggtatgcctctgggctgtcattaccccagtacaatatagccaatgactttggatttctataaaacatacctgaagcatatagcatttatcagtagaaacaatcctatatattttattttactataatgggcattgtgtttgaatggtatgccctgaaaaagctagaccctgtttaaaagccccccacacatattccttccattcacgtaataatttgctattaataaaattgctgttattttcacatttatcacaattgatcctcatggccacactggaaagtagcctagcaggtatgatttctcccaacttatgcataaggaatgtgttgctcagggcaattgaaggtgtcattgccattaggaactgatagaggagggacttaaatccaggtgtcacctatcagaacttgctgtttccatcatatcataatgtcccttggctagtccattaggagtgcctctcctcactagtgaatctaatgaacagaataaaacaatcattcatttatgaaatatttgctgagtacctgctatattttgtgcaatgcaattggcactaaggatttaaggtaaacacaatatgattcttgtccttcaggaacacaaaatttactactggaaatagataaacaaaaattttgatattgttttgcaagtaatctagaaggtttttttttttaagtactgtagaaccatgaaagaactacataactctgcctgtgattgtcagaaaaggaattgctatgacaatctctctttgtcaagaaaattgcatagcacacaaaaacagtactgttttggctggagagtcctacataagaactgcagtaggttaggaatcaggagatctgactttatagaactaatttttagagcaactttggcaatttgccctccttttaagcctcaatttcttcatctgtgaaatgaaagaatcaagctaaatgataggtaaattccctgccagccccgaggttttgtttgtttatttatttatttattttttacttttctcacaaatgtgcataaactccctgtggggctgtttcagaaattgcttcttagatttttctttcaagttaggacctcattcatgatgttggtttctcttttcactgggaggttgattctcatttccattgcctattggcccacagagtctgttgtttgccaggaagtctgggatcaaagcccagactgtttcaattgggattattgatatgtgctttactgcattatccagtatttagtttgagctaagaactttctaaactatgaatgccattttcatttctataggtgaaggataagaaaaaggagaaatcttctgacttttattatcgtagaactgctgtgaccacggatacacaaaatagctaatgttgctctagggaaactcgagactgggggccatatatatccatatttaaacttaggctgaaagcatatctagtttccattaaagatgatgagtgtgttattttaagtttgggatatctttgctgtatgagtttctacttctttgtattatttatttcattgtctacttatccatattatatataactccactgcactcataataaaacataatttgttcatatgcttcaaaaatttccatgcactcacatacctatatcaaaatgcatcacatgtataataatgtgcctaattctcttgaagtatacatatatagatagttacaaaaaatgatattaatactgtatatactgttttatagtccctaacttaactattgttgataaattgctatgttaaacggttagctttaaatcttcatttttaatgtgtttaatcttttttaaggttctgctgtaagttatttagaaaattaatgcaaatctaattttcataattataagcagcaattcaatgaaaattctcatataaaaatatgtgaacattttcttagtagcttttaagagaaatttctaaaagtgccaaatactttttaagttaaaggccatgtactttttagaactctttatgcgtattataaaatttcccttcaaaagggcacaagagtttctgtttttcacatctttactaactttggatactaaacagagatttatttatgaaaacaaaagcttttattttttctttatacctttttaatttaacatacatctagatctagcttagaacaggtgccaaggtttcatgctttactccttttgagtcttccctggattgtcatataaaataagctccactgttgcagtttttttttgttgttgttgttgtttttttgtttttttttttttttttggtgttttcattaggtagcaaagagtagagaaacactcatgactttgactcagtgtcagggatttcaatcccagctttctctcaaatgctcctatccacaaaacaacaattatgaccgtgataaataacttttacaacaccacaggctttccaaaaacatacatatttattttctctttattttccagaccaatattgttaaacctggggaaaatacataacttttaaacttaatgatgtgagatgaagatggttgctctttgtcctgccttgatcgctgccccacattcaccagcttttcatttaagaccttttcttaaaataagccttgtagaatttccttgatgtattataaagtcccatttattcattctacaaaagtgttttctgtgtaatatactgaacttagggtcaagaatttccagcaacaaatacagtgctttacacatagcaaatatttaataaaagttttgggactgatagatgaaagattaattggacatagtgcctgccctcaaggcatttttcagacaaatgaagaggatgggagaaaaaaaattgaacgatattgtcatatccaatgataacattgattgaaatcaaagctaaatatcactcaacactgattaggtaaaagagaacatgtagtctcagaaagataatttccattagaaattgatacttgacctgggacttaaggaaaaaagaggagtttgctatttgctaagagaaaggagaaagagcagacaggagagcatgagattccagtcagtgagagagaaacatgggatgaaggaaacattataatatgcatggaaggaaaaatcagcatggtattttaccatgtgtcatgatactcatgacatattaagagttattattttctatgtttattcttagctccccaactaaatataaagggaggtgaggcaagagagagagaggaagagatcaagatccataatgcttttttttttttaacaacagcaattcatgaaaatgtttaaagggatgcagtaaataatatattcaaaatctagatagaaataatcaaaaacccatcttaattatcttataccaaaataggatcctatattgtgacaggtaagagaatccaacaaatttagaacctattttaaaaagcaaaagaaagaagagattattagcattgtaaaattagtgatgctggacttactaaattctagtttctgctgcttacagtgtcttagtatcatctcaagcaaattagaataatttaatagtaagattatttgtgctattgcttaggtcatttaagatatgcttattatatctggcattttctcaggatttttttaagtgggtttataattaaaaacccaatcttgggctgggcacagtggcttacgcctataatcccagcactttgggaggccgaggcggatggatcaggaggtcaggagttcaagaccagcctgatcaacatggtgaaactccgtctctactaaaaattagcggagcgtggtggtgcatgcctgtaaacccagctacttgggaggctgagtcaggagaatctcttgaacccaggaggcggaggttgcagtgagccgagattgcaccactgcactccagcctgggtgacagagcaagactctgtctctaaaaaaacaaaaacaaaaaacaaaacaaacaacaacaacaagtaaaagaatccagtcttctcatgttgaacacctagattttgcagagatgatatcaatgtttgtacagtctctgaaactaatttggtatacattaattcaacagcaaacatttcctgtttgtccactctgtactaagaaattatccaggttctaagagtgtaataaaactatgcttgtttctgtacacacacacacacacacacacacacacacacacgtgtgtgtgtgtgtactttcctttcatctaggtaatcacaaaaagaaatacaggcacctgtttctttccacatcttccctagagaacaatattgcttcatgatcttcacagaagtcaacttgtgacaaagaattatgtaaagatcctaagatcctaagatctcaagagcatttttatcagtttatgaagttcaaatcattttagcctatttataagacatatataatgcaggatccatggcagatatgacttcccatgcttaatgaaaatcagtcatgaaaatatcatggcacttaaaaaataattgcattccttaccatttgttcctggcttttttatcataaatcttcacagaagtaaccatacagaattgaagtcaaatattatgttctgatctaatcttcaataagtcatgtggtgagtgtcatatgtatattttaaattatgtcttttgtaaaatttaaaagaaaagacactttttataaaaatttaattcacttattcagcatacattattaaggatcttttattccaaacagcatactaggacccagaagtatggtattaaataagatagtattttctattaaaaaggtgtttaagagttatttgaaattgatgattcataggaacaaaaatataacagaatgctaattgctggaaacagttcaaatactgaccttgctttgctttcattagctaaccacatggctgattccttgaaacacattgtgtccatggatcttgtctctcccactacttattttaaattacgttggaaatgcaagtggtcctgaagatcagtaatagtgtttatgctagcagtaatagtacactaggcaatttaattatatccttcagaagacttttctgaaccaattagttgaacccattttctctgagtaattcattgtagtctatttcaaattactaatacgtttcattaaataagtaacaatccagatgattagctaattgtttttctttttttatcaagaaagcttctaaaatgtctctccagggctctcctacacaatagggacatatgcaactattaaactcgttgttttctcaggctaagggatccactatgatacccacattagcaatatggcaaaatggttatgaacataggctgaattctgggactcagttcagctgcttactacagaaatgatttttggcaaattatacagcctctttaagccttcatttatgcatatgtaaaatggagagtgctaataatatctcattgatagggttgtcatgatatcttgaacactcatcacagaagcttgcattaaaaaatctgttcaatattgtaggtattattgttattattaacagtaattagttatttctaatggcttcacagataccttcaaatggaaagcaatcctttcactattatatttgcccttccctagtatatgatccatcctagtagagtatctttgttcatggtcaacttattttcccttctcttccaactgcatagtccacttcaagcctttcctttatgatgtctttgaggtagtcacaacactggctccttggccttgggtagccactattatgtagcatggaggtcactgggctgtgaatctgaaactggatcagaatctgtaaccagctgtacaactttggccaagttgcctgcccctctctgggatactgctttctcgcttgtgaattaaaggccctttcagttccatatgccctaatatttgtagaacttctacatgtggagatctcaatccctctcaatatagtctcatgttcatataatgggaattctaccatttttctacatgttctagctctgattgttaaaatattcttgtttgttcttatctgaaatttctgtaagttctacttattgcattttggtctttcattggaggcacacagtggaaattctttcttatgtaatagatcgtgaaggatggtaatcacaccatatcagagatctctgggctttacagccatagctatcttagctatttttttgcactaactggtctcatgaagaacattggatgctatgtgtagcccatctaggaggaagatttattatgaaatgtactatttggcctaattctttatccaagcagacaaagtaaccataataaccctccagtaacaggatatgatgcttcaccttaacactcgttcatcatcatcttctttattgctcaggtttgaagctatttaatatcaaatacatatactttattttcaagttccattaaacttacctccatgatgctcctcacatccatgcccatggactcaccttactttatgttcctaacatgtcaactggaatagatttctaactgatcattttgcctctagtatttccaccttgattcatcctctaaatgtctaacagaatatttttttaaaaaataaaaacacataatttattcaaagtatgtggtctgactgtaacccaatttttcaggctgactacactctcacagatctgccagggaattttaagccatggtaaataattcagattgataagaacaaaaagtgtccacagaatggtgttacagaggaaagtgaaataactcatattactagaaacattttaatttagtgcaaatagtggcttgaacatggggtaacattagaggcaggtagaccattcaggaggttattgcactagtccaggtgagagatgctggtcccctgaagcagaatagtggggacgggaatgcttaagaacatgcatgttccaggtatattaaggattccaaaccattatattaattatctctcaccttcaatcccagcaattttcgaggctaaaggctgaggcaggcagattgctttaggccaggaattcaagaccagcctgagaaacataaagagatccttgtctgtatataaaattagccaggcatagtggtgtgtgcctgtagtcagtcccagctactcaggaggctgagacaggaggaccacaggagcccagcaggttgaagtgtcactgagctgtgatcacaccactacactttagccacggtgacagagcaagacctgtctctacaaaaacaaacaaacgaacaaacaaaaaaaacagtcttctctgttgtttcctttcccaacctatccctgcttctttcagatccttctttcttacttaacttcttgagtgcttcctgactcccgtattggccctcccagtaggtttgttctgaaactattatagttctggaaaattatgtaatgactatatcataaaatataagctttactgagaatcccagaaacacatcttaatttttatatccacattaggaatgttattcttagatctaattaaaattcttcccaatactattatttctatttctgtgtcttataaaaagaagaaccttcctcagaatatgcaaaaatataccatatcttaaatgccagattgatactacggttctaccatcaatgagttattcccatgtttttaaacctgaggtccagaaatacctagcagtccttagatgttcactataaaatccattaattctctcgaattatatgtcaaatttttatatatgtgtaaatctggaaagcacatagcttataccacaggttaaaattaattgaaacaatgaaaaaatacagttcatatatatgctttcttgttcctatagaaatccctaccttaggtttaagtttgggctagattatatatttaagtgctgttgtgctttcagttaggattgatatgagttattcagttaggtggcaactgctctgtaatacatatcatcaatttggagataagagtctgaacagaagggtataatctgtaactataagaatgcatagtgatcataaacataaggctagtgctatactctaaatagtatcagaaatagatcatgatgatgcatattacaaggcccgtcttactctaaatagtatcagaaatagtctctaaatagtatcaaaaatagatcatgcccatcttacatgggccacaaggcccatcttacatgtttaaaactttgtaatttttaaatatttttcaataatacttgcacatattctaagcgtatgtaaatacaaatggttatggtataatttcattaaaaaaacactaataattggtttaagaaaagacaatttaaaaagcagtatttcacctcagaaccatgtcttatagttttcataccccttcccaaatacctcagtatgttgggtgggacacacaatatgtgcagactaaatattgattgagttgtatagaaaaattcccatctttaagataactttttttacaatggagaagtaagctggagctttatcagaccaatctctagaaatatcccctagttgtaatgttactgtcatttctttgatactagaaataataggagtcctgtcataaacatgttttgctttttgaacacagtatgttaatggaaacccataaaaagagtagttttcttggtcaccacattaccacatatgtttagctttttgttttttctatttagagattgggcaccaaagatgctaattctggcctataaatagcccaaattagaacaatagaataaatgtcctaagttcctcataactgatattgcccaggtaagattcatacatgcagactcatctgtgcatgaaatggactctttctagagcaataatatctatgagatattttcaggcccctactaagaaaacagggctattgattttagtgtaaagcccaactttctaatgccactacaatatttttttaaaaaactaggttgttggtaataaaattgggtgctgagatgaaataacctaaagagtgagtcttattcctgggattccatattctgactaacatgctctcccaacttgctttggtttcaaaacatgttctactacctagcttttacattgacctaggtagtacactgatcaatgccataaaatccattttactcttttttcagctaagctaaaatgggatgttacaaattattaaataagaaattaatgacataaaagcccagtgaaaaccaaatgaatttacagaatacaaggtaaacactgattaaatgaaagaatataaacctctaactagaagtcaaacatgatttagaattgatttcatttcaatactgattatgccacaaacttgtatgcttttaaaatattgatagagtatcttaaaataatttaaatgtcctttatttaatagcacttgccccatatacttcagtatatattgtaatgttggtcatttgtcatgtattcatattttatattctagaatatataatagaaacaaaaagggctgtccttgtccaagttatcaagttatcaatgaaatttccatttattgcgtccttattatgtgtcaggagacttgcatctattagttttctaatcaagggaggttggaagtgggtgatagtatcagttcaacattagcagtagcagctcagcatttgctgaaggttcagtctttatgtgtggagttgagaataaagagtaaacaagacaaagttgctcttctcaagcatcttatgttttcctaaatgtatgttttcaactcacaattctctcctaacgtattcacctgcatattcagctgcttatatgacatttccagtgcatttttcgtaagcatctcaaacccagccagtgcattatcttaccattgccacttcctcctgtcctcctggtttaagtcttgaaaacaatgagagtagatataatcttctcttacaactttatccctaaattttaattaaggaataaatcctgttcatgctactggtttaacttctttcctatgtgttcattcctctgcgttcacactgtcactgtttgcagacttttgtaatttcttaccattccaattgtctagtattttctgtttccatttcctctcctgtgcttgcaattcatcttccacattgctgccagtgatctttctaaaatttaattctaactgttataaatttccagaggctccccattgcctgcaagataaagttcaaattatttgtcattgcatttgcagcccatcatatgctagccgttgccttcctttctaaacttatcttctactgtgttcatttttactcctaaatgctccagatttacctttccaaactacagtatatcgtgatatttcctactttcaaaccattacctctgttgcctaagataccctaccccttgtccttattcctgatttgtacttcatgctttttctcttccattctaggcatcctgtcctctcctactatcctgagagttgatctatctgtcacatacatcgagcctcatatatttattttttaaattagttatcataccttctctcctagtactattctatatattaaaaaagaagagtttcctgcttcatctgaagttgtaacactcacatggtaaaatttttcatagaacaaatatttccagccaaagttgctgttatggagtatctttaaaattaattcatgcatagtttttaaaaattaatttgcttattcagcaaatacaagcaagacagaattatgttactcaagtcaaagtttgatgggaaaaacaaacacagagattgataaacactgtgcagtgtgtgatgttctgtgtttgtaaataatatgactcatacattatgaatgaattaatgggtagatagaagaaaatatggatttagagcaaaaatagcatacaggatatgggagaattcttagaagttgcttgtacgagccaggtgcagtggttcatgcttgtaatcccagcactttgggaggctgaggagggtggatcatctgaagtcaggaattgaaggccagcctggccaacatggcaaaatcccatctctattaaaaatacaaaaatttgccaggcgtggtgttgcatgcctgtaatctcccagctgccagctacttgggagactgaggcaggaaaactgcttgaacccgggaggcagaggttgcagtgagctaagattgcgccactgccctccagcctgggcaacagagtgggactccatatcaaaaaaagaaaaaaaaaatttgccttgtacattgtagatgttcaataaatatttgttgaattttaggaagctgcaagtacattaatattggtacagcatataatttaccgtaagaataagtggaaggaaaggtcatttggactggttaacttcatattcactagctattctgtaggctttggaatgccactggtgtgtggtttgaggagttagaaaatttcctttgcatttttaatatggtaccacaagggaataatcaagagacttctatcattctaaaagataaggttcataaaaggattttaggaatgtttataaattctctgagtattaaaaatatcaaaaatggctaaatacagtgtacttgaacaaaaaatgttcaatttataacaaaaatgaaaatcattatatattagcaggtacattaacttacagataagccttaccgaaataattcattcttaaattttcacttaaagttttcttctctttctttttttcttttttcttttttttctttgcttttatgttatttaaatggaacttggcctccagaccttgacaattgatctcatcacccacaatttccttcttgttaaaggtattatcctctactttgtggattgccattcacctgtcactcacagattaaatgattataggcaaaaggaactctaacaattatttcactcatatccagatgctggaattggagaccagggaagaactagctttcctaagttcatatctgggtctggtttagaacacgattctcctaatttttagcctagtgatctttcctgtaactatattaacattattggtccaaaaagatcttagcttttcttccaggattactcaccttccttaagaatacattccccaagaggacaatgagaacattgctgccctctaaaataacaatggttcatggtaaaggaggcacagaatctctatcaaactgtcaattgaggaggcgttcatccttcacctaggatttcacacgttttcttgcctatgaaaagttttatctaactactcacatcttccacttaatgtattttggaaaatagctttccatatacaatttaatagccccctttctagtttccctagcaactgacagaattttgaaaacagcatagtttctttaaacagaattggaaattaagaagcatttatgttttaatctacttccatcagatagtcacatttctaaatatctcaaatattttaacatatttttagtaatatatccttacaacttttagagccaagttggactatgtttctgttctcaattagaagagatgtcatgtgaaatatataccctgtggaataaaatataaaatgataatttcaatacttttggtaaatggaattattggataacaatatgatctgcttgttcataaaaattcttcctaccatcccatttttttccatgtgctttaacacctcacatggcccatggcttcctttgactttattcccgctgttttccaatccctctcaggatccctgagtctaaaatttttcatatttcctcttacaatattactattatgattgatctgctttgtttcttctaaaaatacaccacctagcttattgtgttatatccaaagggtttgtcaggtctattttcaaaatgaagtaaaatatttttgaaaagttattctggagctaacaatttatatgcaatggcctgttctgatctaaggagcaaagaagaataaggagatgttcctcccaaagctagagtgcccagtgtgtctagctggtaagcccagcaggatataaagagagtagtctttcagggcaacatttataaaacaaccattttgccaactgctgacctagggacgaatacagtaaaatatcttcccttgggaaattcattgtataatgatgaagacaggcatagatctagcctatgtattgacctgcctacgtgacatctccacttggatatcacataagcctttcaaacttaacatatccagaaagaaaccaaatttctatcccttttttatccctttttccccattcatttccctacattccctatctcaataaatgatattattttattaccaaagccagaaaatgaagacttgtttttcctctctctcttttctttacctcctaaatgcaatccaacacctaatgatctatccttaaagtcaatcttaaacatatccatgcatcaccatcattaatattcttaacccaaatcatgggatctcacctggatggctataagagcctcctattattccagttccattcttgtcacagtcctattcacgcactacacaggatctttaaaagagaagactctttaaaatctataggaaatcatgccatttccccaattaaaatcatttgatactttccaaaaactcttcaaataaatccaaatgccttatcatgtctcctacaaccttgtatggtgtggcctccaccaataacccttgctcattccactgtcttccacatcctctcctttttaatttttgtgatataaaaaaatttcatttctttcctgccctggatattttttaacagttactccatcctctgctttgaatagtactgacctctgctcaccaactctataaatgagtgatgcttggatgtcggatctcagcttatctcttcagaggggcattttctgattgtcctggtttaaaagacacacacacacacacacacacacacacacacacacacacatcatatcatatatcatatttttaaataaagatatctgcttgttttgttcattctattaactacaatctgtaattagtacattttatttacttatttacttgtatactgtcagtcttttccacctaacagccatcttcaaagggcatctgaaacattataaaaacttactgtgtattctgaataatacatacattatttcagttttaaatcattctacaaacatttatagattgcctcttatgtgccagaagctcttcttgtcccagagtccagcaattagcaaaacgaacagaagcccctgtcttcatgaagctcatatttaagtggagcgaggaaaggggatagataatagacacagaaaggtatgtaacgtaaaaaaataaataaagcaggaaaggggcatcaaaaaagtgtctgtgggaatgatgttttaaaataaggtagtcaggaatgtccttaatgagaagatgatatgtgagaagacttaaagatggggcagggggagccatgttggtacctatggaaagagctctccaggttgagggcacagcaagaacaaaagctcagaagtagaacatgttccacacattgcgcaagtagcaaagagtctagttggctgagatgagttgaaagagatgagttcaaaaagctaaagagagtagattggttaatgtaagaactataagcactttggcttttggaagctttcagaggatttgtgatgttagctaattatatcaagtcatggcaaagcaatgcattaagaattctttgagctcagaggtaccacctcaaattcattctgggtggtgcaagggagcaatgtcaacaatgacttattggagaaaattatagctgagatgaaatgactcttacctatcaaattcctattcacattcagaacacatgcccagtgttacctccatcacctgctgctacgtcttatggatagttccatttcactatgttgtatgtttatcatctatttctcagatcacaattctctttgtactagggaccatgtcatattcatgtacctggcacagtgtatgacaaatatttgatatctcttggacacatgagtataaaagcagagaacagaaaatgtatgcttccccttggtagttctgaactagcagatttttacactaagtgaatgggcatcctatctaatgtgtcaatatatgaataggtaacatttattgtctttggaacctgagcaaagcaggaaagtgctcttacacatcaagtatcagcttgttttctttccagtagtttactttccaccctgcctgaagataaatggtgcatagtcactactattgttgctaaccatgtcaaaaatggtaacatatggatactctttcttaacttctttaattatagaatgttcaataaaaatttgaggcttcacttcatcagtcacaacagagttttcctaaaatttgcaaatacctgtagtagaaatgactaactaggccaaagaactgaatgctttgactgcatgatgttgtgtctccgaggataatacatcatcttctatcatgtttttaacatcgtaagtacacaaatattcttagatatgattgttcatctgcctaattattttaactatagatgttttgaggtcataagtaatgggacaaaaatctttatttcatctttttcaatttattctttgaacaacttacgtccatttcttcttgatctattcatctccaaatcaagtttcagtacaaactagcctttcttctttaaaacgtaaaaaagcatttggagaggaagatcatgcccactacatttagaaatttaccagaataactaccaaaacagaaagaatgaaattctgccaaagtatgtaattagttctcaaaactatttatttgaaggccactaattgtaagggaacttaactgcaattttaatgttactaagtaaccaaacgcttactgtgggatcatttcagttgagatagaaagataatcccatacactccacctccactgacaagcctctgcagaatacatttggaatactttaagaggtctgtttaattctagtaattgaaatgtcctgcggttttagtgtgttcgttaacatagtgtgctaaactgaatataaaattttataccgcaacatctcttgggaatgatttcaaaatgttggctaaattcagctcttagtctatgatttatatgtcatatagagagctgtaaatatatttcatgataaatttacaagaagagattatgtgatggatagaacagttaaacatttgcaacatgtgaccagagattaacattcccaaagacgggcagccctgtatctgctaatcgggtttatggacttgcttttattttgtaattctatagggagaaatgaaatcctgcatttatggaatcatgttttaaaagccttcatttcctaatccctcagttaccttcatttataaaatgaataatttctacccattacaacacagtatttattcaatagaatgggaagggatagaatacaccgatgaagaacacaggctttgcagtctgtgttctagccagtcaatctctaacacagctcttcaacatcaggtcctttacttagccttgtgagccttattttattcctttatattaagtggtgggtgatacttatcaaagaaaattacttgcatgattaaatatgatttgtattcaaagcacttagtgtaatatgtggcacagaagtatgtgtaaactcagtgagaagagtgtattgatcagttattcctatggtgggcacataagtggagaataggaaaagtgtgcttcctactggtatttctgaactagcagattttcactctaagatattgaaaatctcatctaatggatcagtatataattaggtcacattgcattgtctttgacatctcagcagaatatgaggctgctgcctaacacaaacaagatacatgcttgttttatttccagtagttattttctaacctacctgctactaaaagatttcctagaggacagaatatggaagataaattatggccatggtggtatagtggtaaatgtataaaaattgagcttaatttttagcatcattagaagctgggaagaaattaatgtaatcggctcctataagctggtatgaggctgtcatcagtactccactgataatggggaattattttttcttctttgtacagaaggactcactgctagcagatttatgggatcaaaagatggaatgtttcctatgtgccagtgtatagatgctttgcaggtactaacctatataatcctcctaaaaccctgaaaagtaggtattttcattcattttcataagagaactaatgctaagatgttttctaagtgcatacaaaaaagtaagacacagaagtgcccttttgagtcattcatatatcatctgtgcctcagtcacatggatgttctagcatccaagatgagtatgggtagagttgccttcattttccagagagagagagggagaaaacaaaacatttgaattaaaagtgaaactcttggaaaatcatggttattgtttaatagacctaactatacaatatggttgctgctcaaactatgacatttgcttctattgtttcccttgtcgttgcatttattccaattacagctctgacacacctacctacctgcattattatttgtttctttttagtgtgctagtgcctgtaaaattttaaatagccatcttgtatgtgataaataacatctagagtgataaaatattatttcacagaagttcaatgataatgtatatggacagtgaggaagatacccaaaatttagtgtttgattgtttacaggattctaaagattcaggtctgactataattcataaatcatttgaacacaagtcctttatgttgagtttgatttgaagatgtcccaaaattactgtaagaggggatagttaaacccctaagattatgggaaaatgttttctctcccttttaaaagtgtagacacaaacaaaatgtttaggaaataattgatttaaataccaccagttagcacagtaatgtagagtccagcctttaagtcaggcggactttagttctggatctagttttgccacaatctagcatggtgatccttagcaaatagcttaatctccaaacttcaattgtcatctgtcagaaggaaacaatattaatttttaactaatacatttgttgccgggataaaagtaaataatatctgtgaagggcttagcactctgcttggcatatatagtgagtggtccatgaatgagttcagccattatcactattgatgtttcctctgaaacctgccagaacaacaacccgtcagctttggaccatgtgaattgatattttaattatttgggaattatattcacagagacaatttttcttccataacatggtgaaacctaaagctttccaattttcaaagaacagagacttaaagcttcatttataacagggacaatcttaaataagccaatatatataaggtgatatggaagtttatgtcaaaaaaatatgcaattagtaaaagttacccattgatatggtttgactgtgtccccacccaaatctcatcatgaattcccatgtgttgtggaagggaccccgtgggaggtgattgaatcacaagggcaggtctttgctatgcttttcttgtgacagtgaataagtcttatgggatctgatggttttaaaaatgggagtttccctgcacaagctctcttttcgcctgctgtcacccatgtaagatgtgacttgctcctccttgctttctgccattattgtgaggcttccctagacacgtggaactgtaagtccattacacctatttcttttgtaaattgcccagtctcaagtacatctttatcagcagtgtgaaaacagactaatacagcaattattattattattgttattattatcactgctacttctagaagaattgtcattttcttattagaaattcatgttttaaaagcttttgtaaaaaaattagatttaataatatacatattaataaataccatgcaatacagtaacaaagtctgtagagaatccaaattataataaaaattataattttatgaatcacaatacttttcaatgaataaatgcaaaatttacacccaagaaggatagcatgtgaggaatgcttggaaatcaagtgtgtgaattcactactgtgttaatgtgattctcagtcacccactgtcatgcagcaatgctgtgggcagccccattgcttgtaattcttctgctcagcatgggatctcagctttgttggcttgtcagtttcaacaggtgtcatttagcaaagaaatgatttaatccatgatgctagtttccctgaggtggccagaggagattgtggtcagcacattaatgtcttcctgctttgttcatgcttagcaggaatgcaggaactcttcaaaaagtcacagagcagcagaacaagctaactacttgccttacaaatggacctgctggatgcaaccagggaaccatttgtgagaatcaaatgtatttatgatgactggaatcatagccaggacaatcagcctgcctggaaattctgagcaaagtactgcaccgtgcctttgcctcctttaagtgtacatccagacataaatatgggcatagaggtctgaatacagtagtttgggtcctgaatatatctttgaacaaatgaaagatgtgtacctgtataattaggatgcttgaatgtatcttgtgaggtccatctccatttatgtagtgtttccagttctttgctgctgattctcagagcatattttaatactctttagagtcagacatgcccagttatgataatcacatacatgcgtcttacagatgttgaattttctctttcccttcattcttattttcttaaacacttcctctcccacatgctcttcaaaataagcctctgcacaaaaggatacaccaaatatatacatatatatatatatatatacatatatatgtatatatataaaacacagcttggttgcttctctattgtctaatttatgtgtttttccagctctatatgccatatgtacagttactaagaaagactaggatcagcctgaggttattttcaataagtttaaagatttcttagtggaaaaaaaaagccatgtttaatgactacagaaatgaaatgtatgaatagatcaaaggaggatgcaaatttgtctcacacttgagagctgttccccttggtaattggaatttgcttctgagaagttatactgaacactttttcaataggaaaaatatacagggtctggcatggtggctcgtgactgtaattccagcactttgggaggctgatgtagggggccagaagtttgagaccagcctgggcaacatagtgagacccccatctttacaacattttttaataaaaataatgaataaataaatatacagatatccctgaaatgtaaattaatacttgccaactttcatggacattttgtttgtaccctcaaatatattatctgaattaactttcatctgaatattacctgatttacttttatctgtaaagctctgaagtgttcagtactattattatccccatttttcagttgagaagattgactcacccacaagctaaggtactctcccaacatcataaaacgtaacggcagcttgatcagccttatatagggaggctaagaagaggagtgttaagtcatgactataaactcatgttctcaaccatctataatgggagttagaaataaatgaataagcacttgttgcatttataaatattttagaaattttcaaagatgccccaatggaagtaatacaggaaattgtttattagaaaaaagcagcacagtgtagtataaagcagcccagcataatatttaagggcattccagcagggaagacagctattaaggatatgattgtacaattaattgttatcattgtaagtgccacaaggaaaacaggataccatgagagcctattaaaagaagacctccctcatctgtgcaggtcaggaagggattctgcagaagagttgagatctgaaaaattagtcagacttagccaaagagggcatggggagaacattccaggcacagggcatagctctggattctgaggagattaaagaaaaacaaaatgactggaacatagtgaacaagagggagatggggcactaatccaggaaaaaggaatgggaccagtgactagggcagttgccatgacaaagaacaagggaaggatgcaagaaacatcatggagttggaattcaccgaccttagcaacagtgttgatgtacgaggtgaaaatggatcatttgaatcagatgatttctggtgtttgcttttcggtgactaagaatccaaataaggaaaaattttagctgcaatatagaacttaggaggaggagcagcagctccaagggtgatgaatctcctgtatagctctgtgcgtgggtgggtatgagggtgtgtgtgtgagtatattaatttctttaattctgaaattagaaaactttgatgtcatttcctcttgtttctgaaagagcagagaaaaaaattctgttattgaaattttcagataattgggggtttgctaaacagcaggaaaactgagcacttatctagactcgacggtgctccttcctccttaacttctgttgcagtatgatcctctaaacccagcggagtctgatgtattccaggcaccagaggaaaaaaatatgagagattcttattttctttagagcaaatattaccatgctaggttctgccagatgaagaattgaaggaatatcaacttcttactaatcccaaacagctgtgaaaggctaaataatccttacagggttcctattgacagctgtagcagcttacacaaataacttcatgtgttcagaagcagttgagaacagtggagagaacacaagctttagaacaagaaccccatttaaatactatgtttaccacattctgattaatgtggttgcttaagcaaattgctctctgagcatcaggttcttcatctataaaagatttttgtgagaattaaactcaataataaattatgtaagctatttattatacaaattgcagcactggtctacatggcataagcactcaataaatggtagctcattttatttaacccagaagggcagtaggccaagatcttccttgagtagaaaacagtgaaaatgttatgtaaaatgtatttgaacttcatgaagcctaagtgaaaattttcttagtgatagataacttgaaaaaactcttctccccagttaaatagagaaacatttttgtttaaaaatatccagatcacttaaagacaggacctggcactgatcataagttctctgggccataggttctttctttacataaaaagcaacttagactagaccaatgttgtctaataaaactatagtgtgagaggactcaaatataagccaattcatagttttaagtattttaataacaacataaaaatgaagagcagtgggcattccaagatggccaaataggaacagctccagtctgcatctcctaatgtgatcgatgcagaagacgggtgatttctgcatttccaactgaagtgcctggttgatctcactgggactggttggacagtgggtgcagcccacagagggtgagccaaagcagggtggggcatcacctcacctgggaagcgcaaggggttgggggatttccctttcctagcaaagggaagccgtgacagactatgtggaaaaacgggacactcctgccaaaatactgtgcttttcccaaggtcttaacaaccggcagacaaggtgattctctcccatgcctggctaagcaggtcgcacgcccatggagccttgctccctgctagcacatcagtctgagatcactctgccaggctgtagcctggctgggggaggggtgtcgccattgatgaggcttgagtaggtaaacagagtggccaaggaagctccaaatgggcggagcccatcacaggtcaacaaggcctactgcctctagactccatctcggtgggcagggcatagctgaacaaaaggcagcagacaatttctgcagacttaaacgtccctgtctgacagctctgaagagagcggtgttctcctagcatggcatttgagctctgagaatggacagactgcctccttaagtgggtccctgacccctgtgtagcctaactgggagatatctccaagtaggggccgacaggtacctcatataggtggctgctcctctgaaacgaagcttccagaggaaggatcaggcagcaatatttgctgttctgcaatattctctgttctgcagcctccactggtgatacccaggcaaatggggtatggagtgaaactccagcaaactccaactgacctgcagctgagggacctgactgttagaaggaaaactaacaaacacaaagaaatagcatcaacatcaacaaaaaggtaatctacaccaaaccccatctgtaggtcaccaacatcaaagaccaaaggtagataaaaccacaaagatggggagaaactggagcagaaaagctgaaaattctaaaaatcagagtgccccttctccaaaggattgcagctccttgccagcaatggaacaaagctggacatagaatgactttgacgatttgacagaagtaggctgcagaaggttggtaataacaaatttctccaagctaaagaaggatgctgaacccactgcaaggaagctaaaaaccttgaaaaaagataagatgaatggctagctagaataaacagcatagagaagaccttaaatgacctgatggagctggaaaccatggcatgagaactacgtgatgcatgcataagcttcaatagctgattcaatcaggtggaagaaacggtatcaatgattgaagatcaaattaatgaaataaagcgagaagacaaggttagagaaggagtaaaaagaaatgaacaaagcctccaagaactatgggactgtgtgaaaagaccaaatctacgtttgattggtgtacctgaaagtgagggggagaatggaaccaagttggaaaacactcttcaggatattatccaggagaacttccccaacctagcaaggcaggacaacattcaaattcaagaaatacagagaacaccacaaatattctcctcaagaagagcaaccccaagacacataattgtcagatttgccaaggttgaaatgaaggaaaaagtgttaagggcagacagagagaaaggtcaagttacccacaaagggaagcccatcagactaacagcagatctctcagcagaaaccctacaagccagaagagagtgggggccaatattcaacattcttaaagaaaagaattttcaacccggaatttaatatccagccaaactaagcttcataagtgaaggagaaataaaatcctctacagagaagcaaatgctgagagatattgtcaccaccaggcctgcgttacaagagctcccgcaggaagcactaaacatggaaagaaacaaccagtacaagccactgcaaaaatgtgccaaattgtaaagaccatcgatgctatgaagaaactgcatcaattaatgggcaaaataaaccagctagcatcataatgaccagaccaaattcacatataacaatattaaccttaaatgtaaatggtctaaatgccccaattaaaagatacagactgtcaaattggatagagtcaagacccatcagtgtgctgtaggcaggagacccatctcacatgcaaagacacacacaggctcaaaataaagggatggaggaagatctaccaaacaaatggaaagcaaaaaaaacaggggttgcaatcctattctatgataaaacagactttaaacccacaaagatcaaaggagacaaagaaggccattacataatggtaaagggatcaattcaacaagaagagctaactatcctaaatatatatgcacccaatacaggagcacccagattcataaagcaagtccttagagacctagaaagagacttagactcccacacaatgataatgggagactttaacaccccactgtcaatattagacagatcaacaagacagaaggttaacaaggatatccaggacctgaactcagctctgaaacaagcagacctaatagacatctacagaactctctacccgaaatcaactgaatacacagtcttctcagcaacacattgcacttattctaagattgaccacataattggaagtaaatcactcctcagcaaatgtaaaaaagcagaaatcacaacaaactgtctctcagaccacagtgcaatcaaattagtactcaggattaataaactcactcaaaactgctcaactacatggaaactgaacaacttgctcctgaatgactactgggtaaataacgaaatgaaggcaaaaataaagatgttctttgaaaccaatgagaacaaagacacaacataccagaatctctgggacacatttaatgcagtatgtagagggaaatttatagcactaaatgcccacaagagaaagcaggaaagatctaaaattgacaccctaacatcacaattaaaagaactagagaagcaagagcaaacacattcaaaagctagcagaaggcaagaaataactaagatcagagcagaactgaaggagatagacacgcaaaaaaacccttcaaaaaatcaatgaatgcaggagccggttttttgaaaagatcaacaaaattgatagactgctaggaagacaagtaaaggagaaaagagaagaatcaaatagatgcaataaaaaatgataaaggggatatcaccactgatcccacagaaatacaaactaccatcagagaatactataaacccctctatgcaaataaactagaaaatctagaagaaatggataaattcctggacgcatacacgctcccaagactaaaccaggaagaagttgaatctctgaatagaccaataacaggctcagaaattgaggcaataatgaatagcctaccaaccaaaaaaagtccaggaccagaaggattcacagccgaattctacaatgaggagctggtaccattccttctgaaactattccaatcaatagaaaaagagggaatcctccctaactaactcattttatgaggccagcatcatcctgataccaaagcctggcagagacacaacaacaaaagagaattttagaccaatatccctgatgaacatcaatgcaaaaatcctcaataaaatactggcaaactgaatccagcagcacatcaaaaagcttatccaccacgatcaagttggcttcatccctgagatgcaaggctgcttcaacatacgcaataaacctaatccatcacatgaacagaaccaaggacaaaaaccacatgattatctcaatagatgcagaaaagaccttcatcaaaattcaacagcccttcaggctaaaaactctcagtaaactaggtattgatggaacgtatctcaaaataataagagctatttatgacaaacccacagccaatgtcatactgaatgagcaaaaactgtaagcattccctttgaaaaccgacataagacagggatgccctctctcaccactcctattcagcatggtgttggaagttctggccagggcaatcaggcaagagaaagaaataaagggtattcaattaggaaatgaggaagtcaaattgttcctgtttgcagatgacatgattgtatgtttagaaaaccctattgtctcagcccaaaatctccttaagctgataagcaacttcagcaaagtctcaggatacaaaatcaatgtgcaaaaatcacagcattcccctacaccatgaagacaaacagagagccaaatcatgtgtgaactcccattcacagttgctacaaagggaataaaatgcctaggaatccaacttacaagggatgtgaaggacctcctcaaggaaaactacaaaccactgctcaatgaaataaaagaggacatgaacaaatggagaaactttccatgctcatggataggaaaaatcaatattgtgaaaattgccatactgcccaaagtaatttatagattcaatgccatccccatcaagcttccaatgactttcttcacagaattggaagaaactactttaaagttcatatggaaccaaaaaagagccttcattgccaagataatactaagcaaaaagaacaaagctagaggcatcatgctacctgacttcaaagtatattacaaggctacagtaaccaaaacagcatggtactggtaccaaaacagatgtatagaccaatggaacagaatagaggcctcagaaataataccatacatctacaaccatctgatttttgacaaacctgataaaaacaagaaatggggaaaggattccctatttaataaatggtgctgggaaagctggctagccatatgtagaaagctgaaactggatcccttccttacaccttatacaaaaattaattcaagatggattaaagacataaatgttagacctaaaaccataaaaaccctagaagaaaacctaggcattaccattcaggacataggcatgggcaagggtttcatgactaaaacaccaaaagcaatggcaacaaaagccaaaatagacaaatggcatctaattaaactaaagagcttctgcatgacaaaagaaactatcatcagagtgaacaggcaacctacagaatgggagaaaatttttgcaatctacccacctgacgaagggctaatatccagaatctacaaagaactcaaacaaatttacaagaaaaaaaacagccacatcaaaaagtggacaaaggatatgaacagacagacacttctcaaaagaagacatctatgcagccaacagacacatgaaaaaatgctcatcatcactggccatcagagaaatgcaaatcaaaaccacaatgagataccatctcatgccagttagaatggcaatcattaaaaagtcaggaaacaacaggtgctggagaggatgtggagaaataggaatgcttttacactgttggtgggagtgtaaattagttccaccattgtggaagacagtgtggtgattcctcaaggatctagaactagagttatcatttgacccagcaatcccattactgggtatatacccaaaggattataaatcatgctgctataaagacacatgcacacatatgtttattgcggcaccattcacaatagcaaagacttggaaccaacccaaatgtccatcaatgatagactggattaagaaaatgtgtcacatatacaccatggaatactatgcagccataaaaaaggatgagttcatgtcctttgtagggacatggatgaagctggaaaccatcattctcagcaaactatcgctcggacagaaaaccaaacaccgcatgttctcactcataggtgggaattgaacagtgagatcacttggacacagcgcagggaacatcacacactgaggcctgtaggggtatggggggctgggggagaaatagcattaggagaactacctaatgtaaatgatgagttgatgggtgcagcaaagcaacatggcacatgtatacctatgtgtcaaacctgcacattgtgcacatgtactctagaacttaaagtacaataaaataaaaaataaataaaaataaataaagggccagatagtaaaaaaaaaataaaaaaagtacatgattgatatttaaaagagttttcaaaaaggaatgtaagaaataaagcaagtctgcaatgaggcaaagaaaacggttaagagcttcttactgccttcatgtgtatttgagggtcagaggagtgaacccacattttgtttcttctcttttacatttttttgctttcatttttgtttttaccaatcacatattagtcctgaatttaaactaagagcaataataatgtttcaatagatatctttatgtttaaaataaaatgttaagagtttcaagatacagtaagtaaaacaaaacaaaatgtccttcaatgggtgaataaacagtggaatatccacacataatactgctcagttaaaaaaaaaaaagattgataagcgttgatacatgaagcaactcaagggcagtatgctgagtaaaagaagtcagtctccaaaggttacaaactacatgatttcatgtttatgacattctcaaaaagacaaaaccatagtgagggagaacaaaccagtgattgccatgggaatggagggagatgttcagggagatgaaacttttctgtatgccgattatataaaaattattgagctattttgctttctcttttggtactaagtcttcaaaaccatgagtgtatttcacactcacataattgtgattattaatgttagctgttaccttgattggattgaaggatgcctagatagctgtaagtattgtttctgggtatgtctgtgagggtgttgccagaggagattaacgtttgagtcagtggactggagaggaagaccctcaatgtggatgggcaccatccagcgcccattagaacaaagcaggcagaagaaggtgggagaagcttgcttgctgtcttctggctttcatctttctcccatgctacatgctcccatctgttcctcttgcccttgaacatcagactccaggtttttcagcctttggactcctgcacttacaccagtgggttgctagggactcttgggccttcagccgtggaatgaaggctccattgtcagtttccgtacttttaggctgttggacttagactgagcccctcctgccttcttttttcctcagcttgcatatggcctattgtgggactttaccttgtgatcgtctgggcccattctccttaataaacttcctttcatatatacatatatcctattagttctatccttctggagaaccctaatacaagcatgtcttaattcctgctagccacattcaaggggctagaagctaccatactcgacaggccagggctaggtgatctctaaaaatatttccttgtctgtctatgctattagctacatattaagatgtttgttttctgattttatcaagtattatttttcttaagcacatggtttgccatgtagtaagggatacatgtctgatttaagtgactaaaaaatgaggaaaagtcatttaaatttcttggctactgctgagtggcaatatggtcatatctgtccaggaatccattctgacgctaagtgacaaatgcccctttgttattctgtttcaaaccgaatacattatcacatgattgtacttagattaacgttctgacaaattctagtaatacatgtgtcataaaagatttaaatcattagatgcccccaaaatgtaacccctatcaatttctgtcaagaatacattcttttctggaagcatattcctgttactcctttcatgtgataaaattctgttcagttttggtgacacataccatccatcacatagtaataaatcaaatatataaccaagccaacaatttctgctttccacaaggttaaaacaggaactatttagttatatcatcaattaaccaaaagcaacatttgttcaattgattttctatgaatcaacttcatttttaagagaagttttagattcactaaaaaattgagcatatagtacaaagaattcctacattacctctctttcctctgacatacacagagtttattattaacacattacattagtgtagtatatttgttaaaattaatgaaacaatatcaatacataattatttagtaagagaatatttattaagaagtccatagtttattaagattccctttgtttttatctaatgccctttttctgttctggggtcgcatcgagtataccatattacatgtagttatctggactccttaggctcctcttggctgtaacagtttttcataccttatttgctttcaattactttgaaagttttgatgagtataggtcaggcattttttagaatgtctccaaattgagatttgtctcatgggtaaattagggttatgggttttagagaggtagatcacagaggtaaagtactattttaatcacatcatatccagggtgtatactatcaacatgatttataactgttggtattgaccttgatcacctgactgaagtagtgtgtgccaggttactctgctgtaaatttactatctcctccccacttccatactttactctttagaaggaagtcactttgcacagctcatacttaacagtggagagttttgctctccctcctttaggatgaagcatttacataatttatttggaattcttttgcatcgttgattattgtcctccacttattaatttattcgattttttattcacatcagtctggacttgcagatgttaatcttagaattaaaatccagcactattttgctgctcaaattgtcaatctttgtccactaggagttctttcagttgattcttgtgcctttttgacatactgccatcaatgtattttgttcttgctgttgctgttattgttgctttgtgagggcttccttacccaatggaaccacaacatgctccaggctcatcttttatatttcctgcacctgaaccagccatttctccaagcaacactggttactttctttggaaaataataatagaaatcaagatctggatctgggtgttgcatatactcattactgctctagtgccatttcttttagacacttaacagttggcaaaacaaagaaataaatgtgtgtataatgacctgtgtatatacacaagtccataaatatctctacatgtaacgatctatatctatattaagttgaacatgagttcttattgttgtctccaagtctaaacaattaccatatggatcaatctcatctcctcaccatgccaatccacaaattcccactccagaagtggaaaacctggctgccaccatgagctattcatttgcttccttgcttaaggaatatttatatatcagaatcagaattgttaccccatatacctatgggaaacaaatttattgactagagcgcagtacttaacatgcagtttctttagcctagtcttacagattccattcatttctaaagttaacttaggccagcaactccttggtgaggctattttattcatggaggtttgaagggaagcataaaacaacaaaattttattctgttacatttctggaggtccagtgtataaagtgaaggtgtcatctgggctacacaccttctggagccttcagagggaaatcttttttcttgcctttttcagcttccagaggctgtctgtatcctttggtccatcttcaataactcctcatcaccccttcacgtggccttttcttcacatcatgccaacttctgtcatcccatctctctccccattcactctcttgtctctttcatataaggaccagtgtgatgacctttcaggtgtggctatttttaaattatctcttttttttttcaatttttataggtggttcatacatataacaaaaatggatcatattcaacattgttaagtgtatggttcactggtattaaattcataatgttgtgcaaaccttaccaccatctatccccataactctttttatcttgtaaaagtgaacctctatacctattaaacagtaactatccattctctcctcccaccagcgtctggtaaccaccattctactttctgtctttataattttgactactcaaagtacctaatataaatggaattatacatcatttgtcttttctgtgattggattacttcatttaacattatctcctcaaagtcatccatgttatagctatgaaagaaattccttctttttaaggttgaataatatttcattgtatgcatatattatgttttcttatccatccgtccatccatcagtgggcactggggttgctttcacattttaactgtggcaaataatacactttgaacatgggtgtaaacattatctctttgataccttgttttcaacgttttgggtatgtacccagaagtgaaatttctggatcatatggaaattatatttctaattttttaaggacccatcatactgtttgccacagcagctatactgttttatacttctataaacagcatacgagggttccaatttccctacattcttaccaacacttgttattacttttttctttttatagtgttgctatcctattgggtgtaaggtggtatctcatagttttgatttgaatgtccctaatgattaattatgctaagcatctttaatttttttttaggttctggggtacatgtgcaggtttgttaatataggtaaactgggtcttacagggatttggtgcacagattattttgccactcaggtaataagcataggatccaataggtatttattctgatcctctccctcctcctaccatccaccctcaagtaggtcccaatgtccgttgttcgcctcctagtatccatgtgttcttgttgtttagctcacacttgcaagtgagaacatgcagtatttggttttctgctcctgtattactttgcttaggataatgacctccagcttcacacatgttgatgcaaaggacattatcttattcttttgtatggctgcatagtattccatggtgtacatgtaccacattttctttatccagtcgaccattggtgggcattgaggttgatttcacgtctttgctattgtgaatagtgctgcaatgaatatacacatacatgtgtttttatggtagaaaatttacattcttttgaggatatgcctaataatgcgatttctggatcaaatagcaattctgttttagttatttgaggaattgacacaccgcttttcacaatggctgaattacactcccactagtagtgtatatgtgttcccttttctctgcaacttcaccagcatcttttattttttgaattttacataatagccattctcggccaggaacaatggctcaggtctctaatcccagcatactgggaggctgaagatggggttgaagtgaactgtgattatgacactgcactccagctgtatcaaacaagagaaaaaaattaaatagccattctgactggggtgagatggcatctcactgagttttttatttgcatttttctaacgattagtgatgttgaggatattctcatatactagttggtcacatgtatgtcttttgaaaaatatctgttcacatcctttgcccattttttaatggggttgtttggtttttgcttgtgaatttgtttaacttccttgtagataccggatattagacctttgtcagatacatagtttgcaaatattttcttccattctgtaggttgtctgtttactctgttgatagttccttttgctctgtagatgctatttagtttaactagaattgtcaatttttgtttctgttgcaattgcttttggtatctttggtcatgaaatctttgcctggtcctatgtccagaatgcgattgcctaggttatcttccaggatttttatagttttggattttacattgaagtctttgatccattttgatttgatttttgtgtgtggtgtaaagtagggttctagtttcaatcttctgcatatggctagccagctatcccagtaccattaagtgaatagagttcattccccattgcttctttttgctaggtttgtcaatgatctgatagttgtaggtgtgtgacattatttctgggctctctattccattccatttgtctatttgtctgtttgtgtaccagtaccgtgccattttggttatgggagccccgtagtatagtttgaagtcaggtaatgtgatgcctccagctttgtacttcttgctgaggattgccttagctatttgagctcctttgtggcttcatagaaattataaaatagttttatctagtcatgtcaagaatatcattggtagtttgataggaatgacattttaatctactaattgctttgggcaatatggccattttaataatattgattcttcctatccatgagcatcttttcatgtgtgtatggaccattcagataccttctttgggtaaatctctattcaagttctttgcctttttttgaatcagagtgattttgttgttgagttttaggacttctctatattttctggatataagtcccttatatatataagttgcaaacattttctcccattctgtgtgtttcctttttattctgttgatagtgtctttgtatacacaattttaaaacatattcctgaagtcaaatttgtctattttttgttgttgtgcctgtgcctttgatgttatatccaacaaatcattcccaaatacaatgccatgaagcattttcattaagtttttttttctttgagttgtataatttaagaattatatttaggtctttcatccacttgagtcaatttttgcatatggtgttaggtaagggttcaaccttattattttgtgtgtggatatccagttatccaagcatcatttgttgaagactgccattttcccttctcaagaatggtcttgacacccttctcaaaaaccatttgactgtatatgtgaaggattgtttctaggctctctgttctattccattaatctagatgctaaaaccacactgttacgattactatggctttgtagtaagttttaaattggaaagtgtgagtccttccactttgtttttttttttttttttttcaaattgtcttggctatttgagctcacttgaaattccatattaattttaggaaaatttgagaagtattggtgttagtttttccttaaacagttggtagaattcactcatgaagctatcagacccagggcttttctttgtagggagatttttttgattcccagggtttttcttttttgggagacattttgcttacagactcaatatccttactacttacaggtctattcagatattctatttctttatgatttagtcttggaggttttgtgtgtttgtaagaatttgttcatttcatctaggttatcaaattgttactgtacaattattcataatactctttataatcctttttatttccctagaatttttcatcatgtctccacttttatttctaactttagtaattgagtcttctccccttttgtttgtccatctacctaaaagttatcaattttgttgatcttttgaaaaaaccaagtttggttttattgattttctctataatctttctagtctctattacttttctatttaagttatatgtgctctaatcttcattatttccttccttcttctatctttgggtttagtttgtttttattctagtatcttaaagttaggttgctgatttgaatttttctaattttttaatataagtgtttatagctataaatttcctccttggcactgcttttgctgcatcccataatttttggtatattgtgttttcactttcattcatctttaagtattttccaatttcccctgtgatttgtttttttgattcatgtattgtctaagaatggttatttatttcccacaattttgtaagttttccatttttacacctgttactgatttctaatttcactcttttgtagtcagagaaaataactttgtatgacatctataaaaaaatctattgagacttaatttgtggtaaaatatgtgtattttattctggaaaatgtcccatatgcacataaaaacaatgtctatgttgtgttgtttggtagagtgttcttctgtatatgtctgttacatctagttggtttattgtgttgtctttatttccttccttatcttttgtcttgttgttgtaatcattattgagaatgaggtgttgaagtctgcaaccgttatgataggactattctctctttaaatctgttcatttttgcttcatatattttgattgtctgttcttgtgtatgtagatgtttatatcttcttgttgtattgaacatattttctcaatatgtgatgcccttcttgtctcatgtgacactttcaaatttaaagtctcttttttctaacagtaatataataatattttctgtcttttggtttgtatttgcatggcgtatcttttttcattctttcactttcagtctatttgtacctttgaatctcagtgggtctctggtagacaacacagatttggatcaattgttttgttcattctgccaatctctgtcctttaattggataaattatttacatttaaggcaataaatgataaggagtgacatttctgtcattttgctttttcttttctatatgccctcattttctgcattaataacttcctttgggtttatctgattttttatcgtgacaaattttatttttgtagatactctatagctatcttatttgtggttaccatggggattacatctaacaccttatacttttaacactgtaatttgaatttatacctgtttaactttaataactttaataacatatagagattctgttcttttaacaactctgtcctcacgcctttgagctgttgattttaccattacaattttacacattgtgagcccaaacacatatgctaataatactttaaacacatttgtcttataaattatgaggaaaataaaatgtggatttactaaccaaagttaatcctagctttaaactaataattttagtgtttgattatgtaatttagtcatgtagaaaacaagaagtggcattgtaaaccattgttacaatggtagtaatttttatgactgtggacatatttaccttcagtgacattgttatgtcttcttatggctttgagttattatctagtgtcccttaatttaaccctacaagactccctcaaggcctatttcatgtataaaagatttagtgctaattaattcttccagcttctacttgtcttagaatgtcttaatatctccctcactttttaaacttttattttaggttcaggggtacatgtgcaggtttgctatataggtaaactcgtgtcatgggggtttgttgtacaaattattttgtcacccaggtgttaaacctagtactcatcagttatttttcctgatcctctccctcctttcccgctccaacccctggtagtctcccacgtctgttattctcctctatgtgtccacatgttctcatcagttagctcccacttgtaattgagaacatgcagtatttggttttctgttcctgtgttagttggctaaggataatgacctccagtccattacatgttcgtgcaaaagacatgacctcattcttttttatgactgcatagtactccatggtgcacatgtactatgttttctttaccagtctacctactactgatggccatttaggttgactccatgtctttactattatgaataacttatatgtgcatgtgtctttatgatagaacaatttatattcatttgaatatataccaagtaatgaaattgcttggtcaaatgacacttctgctttcagctctttgaggaggtaccacactgctttccacaatagttgaactagtttacacacccatcaacagtgtataagtttccccttttctaaggaaccttgccagcatcttttattttttgactttttaataatacattctgagtggtgtgagatggtatctcattgtggttttgacttgcacttctctaatgatcagtgacactgaatgttttttcttatgcttgttggctgcaaatatgtattattttgaaaagtgttcatgtactttgtccacattttaatggggttgtttgctttttacttgtagatttaagttccttatagatgctggatattagacctttgtcagatgcacagtttgcaaaaattttctcccattctgttggttattggtttactctgttgatagtttcttttgctgtgcagaagctcttaagtttaattagatctcatttctcagtttttgattttgttgcaattgcttctggtgtctttgtcataaaatctttgctcattcctatgtccagaatggtattacctaggttgtattccaaggtttttggggttttacatttaagtatttaatccatcttgagttgatttttgtatatggcttgagaaaggggaacagtttgaatcttctgcatatggctagccagctatcccagtaccattcattgaatagagggtcctttctccattactttttttcagctttctcaaagatcagatggttgtaagtgtggcattatttctgggtcctctattatgttctgttgatctatgtgtctgtgtaccagtaccatgcttttttggttactgtagtcctgtagtatagctggaagtcaggtagtgtgatgtctctggctttgttccttttgcttggaattgtcttggctattcggaacctttttttggttccagatgaattttaaaatagttttttctagttctgtgaagagtatcattgatagtttgataggaatagcattgaatctataaattactttggacagtctggtcattttaatgatgttgattcttcttattcatcaacatggaatgatttttcatttgtttgtgtcatctctgatttctttgagcagtgttttgtaattctccttgtagagatctttcacattcctggttagctgtattcctagttattttatttttaagggagaagttgtgaatgggaatgtctttctgatttggctcttggtttgatggttgttggtgtttaggaatactagtgaacattttaatgttggttttgtagcctaaaattttgatgaagttgtttatcagcttaaggagctgttgggccaagactatggggttttctaggtatagaatcatataatctgtacacagggatagtttgacttcctctcttcctacttggatgccctttatttctttctgttgcccgatttctctggccaggacttcgaatactatggtgaataggagtggtgagagagggcatcctcatcttgtgctgattttcaaagcaaatgcttccagcttttacccagtcagtatggtgttggctgtgggtttgtcatagatgactcttattgttttatgttccttcaataactagtttattaagggttttttaacatgaagcagtattgcattttttgagacttttctgcatctattgaaataatcatgtggtttttggctttagttctgtttatgtggctcatcatgtttattggtttgcatcccttgaaccaaccttgcagcccagagataacgcctacttgatcatgacggataagctttttgatgagctgctggatttggtttgctagtattttgttgaggatttttgcatcaatgttcatgaagggtattggcctgaagttttctttttttgttgtatctctgtgagattttggtatcaagatgatgttggctttgtagaatgagttaggcaggattccctcctcaattttttgaaatagtttcagcagaaatgataccagctcttttttgtacatctagtagaatttggctgtgaatccatatggcactgagaattgttttggttggtaggctatttataactgattcaatttcagagcttgttattggtctgttcagggagtcaatttattcccggttcagtcttagcagagtacatgtatccaagaatttacccatttcctctagattttctagtttgtgtgcatagaggcattcacaatattttctggtggttacttgtatttctatggggtccgtggtaaaatcacctttgtcatttctaattttatttatttagatcttctctttattagtctagctagcagtctattttataatatttctgaaaaaaccaactccccaattcattgatcttttgaatgtttgtttgtttcttaatttccttcagttcagctctgattttagttatttcttgtcttctgctagctttgggattggtttgctgttgattctctagttattttagttttgatgttaggttattaaattgaaatctttctaactttttgatgtgggtatttagtgctataaatttccttaacattgccttagtttgtctcagaaattctggtatgttgcatctttgttcccattagtttcaaagaacttcttgatttctgccttaatttcattatttaccccaaagtcattcaggagcacattattcaatttccatgtaattgtatggttttgagtgcatttcttagtcttgatttctaatttgattttgttgtggtctgagagagtagttgttataatttcagttcttttgcatttgctgaggggtgttttatgtctgattatgtggtcagttttaaaatatgtaccatgtggcaatcaaagaatatatattcctttgttttggggtggagagttctgtagatgtctgtcaggtctatttaattcagtgctgattttagatcctggatatctttgttaattttctgcctcagtgagctgtctaatactgtcagtgaggtgctgaaatctcccactattattgtgtgggaatctaagtccctttgtaggtccctaagaacttgctttatgaatcagggtgctcttgtatttagtacatatatatttaggatagttagctcttcttgttgaattgaaccctttaccattatgtaattcccttctttgttctttttgatgtttgttggtttaaattctgttttgtctgaaattaggattgcaatgcctgctttttttctgttttctgtttgcttggtagatttttctctgtcccttaattttgaacctttgtgtgtcattgcctgtgagatgggtctcctgaagagaccgtacattgggtcttgcttcttaatctagcttgctaccctgtgtctttaattgggagatttagcccatttacatccaagatgagtattgatatgtgtggatttgatcttgtcatcatgatgttagctggttattatgtagacttgtttggttgctttatagtgtcactggtctgtgtacttcagtgtgtttttgtagtggatggtaatgatgtttccgttctatatttagttctttctttgggagttgtaaggcaggtttggtggtaacaggttccctcagtatttgcttgtgtgaaaataaccttatttctccttcatgtatgaagcttagtttggccagatatgaaattctgggttcgaatttcttttctgtaagaatgttggcttcaatctcttctggcttgtagggtttctgctgagaggtctactgttagcatgatggatttccctttgtaagtgacctgagctttctctccagctgccactaatatttattcttccagtttaaccttggagattctgagattatgtgtcttggggatgatcttcttgtgaagaatcttactggagttttctgcatttcctgaatataaacatttgcctctctggctaggttgtaaaagttcttatgaatgatatcctgaaatatgctttccaagttgattccattctccccaacgctttcgagaacaccaatgaatcttagatttggtccctttacataatctcatatttttctgaagttttgtttgttcctttttattcttttttctctattcttctctgactgtcttatttcagaaagccagtcttaaagctctgaggttctttcttcagtatggtctattttgcttattacttgatagtacttgcaattgcattatgaaattcttgtagtgtgtcttccacgtctattgggttggttacatacttttctatactggccattttgtctgtcaactcatgcatcattttactgtgattcttagcttccttggattgggcttcagtgtactactgcctctcagtgatcttcattcctacccaatttcaaatactactgtaatttcagacatctcagcctgattgagaacactttgctggagaggtagtgcagtgatttgcaggaaagaaggcactctgcctttctgacttagagttcttgtgcttgttctttctcatctttgtaggctggtgttccttcaatctttgaagtttctgtcctttggattggtttttgttatttttatttgaggatttgattgtggtataaggtgggttcagttgattggctttatttctgggagattttagtggggcaaggctcagcttccatctcctggactgtgccctcaaactctaggggacttgcgagtctgactttcctctctggctcctcaaggttagaaaccaactacaatcggtgggcggttggggaagccatggtgctcttggaccactggtccctaaacatcaatgggaggtgccaaagcattttgtagggctatggcagcaggatccattcttgttcacatgtgccagtggcagaggtagcatggtggggttcacactcattgactgcagcagggtgctagtgggtgccaaggttcctgcctctgtattgcattcgtagcagtgggggagacagcgtaactggaggaggacatcccttattggtgactgtgtttgtggttccactggtggtggtgttagcaggggggtgggacattgatgggggtgagacactggtgggcacaagtctgtgtgctctctctgtggctgctcagagcaggcaggggtggttccaccgtcatccatactagtttcactctaatggcagtgttgttgcaggagcacagcattggtgggggtgaggctggcaggctctgtgttcacaaaggctccaactgcaatggcagtagggtaggggaagtggggtggagtgcattccaccagcagcagaggcatggcagagtgcacatgcacacatgtgctagcaggacagggaatgcaaaaatctacctgcatacatgtgcactggcaaaatgatgtggagggtggctgcagtcccgagggaagcttgcagtgtatctcccgaactttcaaaggacatttttgccagatatggaattctcatttgacagatcggtttttttttctttgactgctttgaatgtatattttccccagctcctggcctcgaatatttctggaggaaaaatctgttcatattatttttgaggaccccttgcatgtgatgagccacttatttctgattgttttcaagattttctctttgtgtttgtctttaaaaagtttgattttaatgtatcttggtgtgagttttttgagttccatttaattggagttcattgagcttcttagatatttatattcatgtctttcatcaaatgtgtgaagttttcagccatttgttcttcacatattctctgtcatcctttctcttattcttctgggactgccacagtacataggttatcctacttgatattgtcctacagataggtcccttatctttttactcttctcctacctttttactttttgttcctcagactcaataatttccattgtcctatcttcaattttgctgattttaatgtgtaatatacaatgtataatttatagtttatagtttatacaacaaagttatagtttataatttatagtttagagtttatataacatagttgctatataattttttgtatgtattcatcatttacattttatagaaactcaaaaaatcatatagtactatatgagacatattaattcgactttatattttttataaaatcttgtcatgctgatgtcttatctcttattttataactacaaatgccatgtgaataactgcctagtgaactcttgctgactgaatatgacagcacagatgtataaaatgaaaagatctgagaccctaaaatcttgaattataatgtagactcttctactgattttctatctttggatggagtatttctctgggttctagtctgtcatctgtaaatttgagtattgaaatacatgatttatatgatctcttccatttatgaccactcatgactagtatttctttattctaaatggcaattttattgaagatgaaactggaataacacgaaacacagtcagactgttagaatgctaaagtaaggctgtttccatgtctattggaggcaaaaatttatggatcaccaatccctagatgggtagaatgtagagacagaaaatggctgctaggagcagatacaaagaggtaaatataagccttgttcatggtgaggacaatcagtcccaacctctgtttgtttttgtagagtcatatttttttggcttttgttttagtaagaaatttagggaaaacatcactggacctgtagttagaaaacctggcacagtatcctacttttggcatccatttcctgtgtgactctgtgtaaatcctcacattccctaaggtagaaaattctcaccttgacaataaaagtgccagattcaatattctcaagggcagcttctaaattcaaaattatttaattctctgtttggaggcaaatgggtcctggtaaatatcagaactacttaaagatcatagaggccatctttgggcatagaaaaaatttgctgtgtctctaactcaaaaactgcttaggcatactacaattccataaattattttaattatgtttgtcttagcaggggtggatatagagagtttgcaacaaaatcatgctaacatctgttattgcaatgtaaatataaaatgaaaatactgattttctaggtacttacatttccattgtgataggacactgttcacttaaagaaattcaattttttcctaccatatgattaaaaactcttcctaacctacacagatatggtagctctcatctttaaaccataactttatatgaaaaaattaatttggtcaagttcatgttaatattgaccaagtcgttctactttatgttttttcccatttcagatatattaatttacggcatcttgtaccttctctgagactctgttttctgaaactattgggagaagctagttacaatttgagctcttgagaatccccaagctcttgtctttgatgagatatcttctatttccaaatgccttattgaaacatctaaatacacatttgcttcagtttcttataaggattgttaatccattatatttctctagtgtttagcaggattacagagtgttcttcaatataatatttcatttgaatctcagtaattctgtagagaaagtggggactatatatctctgttttgcatatgaggagagcaaggcctacagaagtgttgtaaaattgttcagagctgcacagcctatgagtgatgacccaaaaataagctgaagtctttaggagcacttgggcagagcacagagacaattgatttggagaacagaccaaccccaactgtagtataactgcagaatttgatgtcagactttggcaagttatagtttgagtttccccatctttgaatttaggaggggataaaaaggtggaaaaatatgatgatgatgatagttaatatgtatgaacacagatacatacagaccctcacatatgcacttataattctcaaaaaatgtaatacccaataactgtaaattttttatagaaaatgtaggaattgataaggatacatctgggagtgtaatgaccacctttgagaatctcagatgtatattcaagtgcctacctttgagtattggttcccttccattctggtagaatattcaatgttgttttcctgccacacctgattgatagagtcaatatacctacattataatgaataattaattttcttcttcaacttttattttaagttcaggagtacaggagcaggatgggcaggttcgttatataggtaaacaagtgccatggtggtttgctgtacagatcttcccatcacctaggtaataagccttgcatccattagcaatccctccaccaacctccccagcattccctgacaggacccagtgtgtgttgctcccctccctgtgtccagtgttctcatcactcagctcccatttataagtcagaacaggtgatgtttggttttctgttcctgcattaatttgctgaggataatggtttccaaatccatccatgtccctgaaaaggacatgatcttattccttttggtgcctacatagtattccatggtgtatgatatggtttggttctctgtctctacccaaatctcatcttgtagttcccataattcccacgtgttgtgggagggacccagcaggagataattgaatcatgggggcaggtctttcccgtgctgtttttgtgatagtgcataagtctcatgagatctgatgtttttaaaaacgggagtttccctgctcaagctcttttttcttgtctgctgcaatgtgagacgtgcctttcatcttctgccataattgtgaggcctcctcagccatgtggaaatgtgaggccagtaaacctttttcttttgtaaattgctcagtctcgggaatgcctatatcatcagtgtgaaaatggactaatacagtgtctatgtaacacattttctttatccagcctatcattgatggggatttaggttgattccatgtctttgctactgtgaatagtgcttcaatgaatatatgcatgcatgtatctttataatataatggtttatattcctttgagtatgtacctagtaatgggattgctgggtcaaatgatatttctgcctctaggtctttatggaattgccacactgtcttccacaatggttgaactaatgtacatttctaccaacgatctcgccatcatctgttattttttgactttttaataatcaccatactgactggtgtgagatggtatctcattgtggttttgatttacatttatctaatgatcagtaatactgagcttttttcatatgtttattggccacatgtatgtattcttttgagaaatgtctgttcatgtcctttgcccagtttttgatggggttgttttttctcataaatttgtttaagttccttgtagaatctggatataagatttttgtcagatggatagattgcagaaaatttcccccaatctgtaggttgtctgttcagtctgatagtttattttgctctgaagaagctctttagtttaattaaatactatttgtcaatttttgcttttgttgcaattgcttttggtgatttcatcatgaaatatttgctcatgcctctgtcctgaatggtattgcctagatgtttttctagggtttttatagttttgagttttacacttaattctttaatccatcttgaattaatttttgcatatggtgtaaggaaggggtccagtttcaattttctggatatagctaacctgttctttgagcaccatttattaaataagaaatcttttcaccattactgttttttgtcaggtttgtcaaagattagatagttgtaagtgtgcagtcttatttctgagttctctcttctgttccattggtttatgtgtctgttcttggaccagtagtatgctgctttggttactgtactcttgtattacagtttgaagtcaggtaaggtagcatgatgccttcagctttgtcctttttgcttagcactgtcttgcccatttgggctcttttttggtttcatatgaaatttaaaatattttctctaattctgtgaaaaatggcaaaggtagtttaatgagaatataattgaatccataaattactttgggcagtatggccattttcacaatattgattattcctatccatgagcatggaatgtttctccatttgtttgtgtcctctctcatttatttgagcagtgttttgtagttctccttgaagaggtccttcacttcccatgttaactgtattcctatgtattttattctttttgtagcaattgtgaatgggagttcattcatgattggcttctggctcgcctgttgttggtatatatgaatgctagcaatttttgcactttgactttatatcctgagactttgctgatgttgcttctcaccttaataaacttttgtgctgagactatggggttgtctatatataggatcacatcatctgcaaacaaagataatttgactttttctcttcctatttgaataccatttatttctttctcttgcctgattgccctggccagaactttcaatactatgtttaataggaggtgtgagagagggcatcattgtcttgtggccagttttaaagggaactgcttccagcttttgcacattcagtatgatattgactgtagatttgtcatatatagcttttattattttgaggtatgttccttcaatacctagtttattgagagtttttaatatgaagggatgttggattttatcacaggccttttctgcatctatttggataatcgtgtggtttttgtctttagttctgtttatgtgatgaattacatttattgatttgcatatgttgaaacaaccttgcatcctgagaatgaagcgaactcgattatggtggataagctttttgatgtgctgctggattcagtctgccagtattttattgaggatttttgcattcatgttcaacaaggatattggcctgaactttcctttgttgtatctctgccaggttttggtgtcaggatgatgctggcctcatagaatgacttaacggggagtcactccctttcaattgtttggaatagtttcagtagaaatagtaccagctcttctttgtacctctggtagaattcagctgtgaatctgtctggtcctgagcttttgttggttggtaggctatttattactccctcaatttcagaactcattattagtctattcagggattcagtttctccccggttcagtcttgagagggtgtatgtgtccagaaatgtatcggtttcttctagattttctagtttatgtgcatagaggtgtttataatattctctgatggttgtttaaattcctatggggtaagtggtaatatgcaccttatcctttctgattgtatttatttgattcttctctttttccttctttttaatctagctagtggtctgttttattaattttttcaaaagaacagctcctggatttgttcatttcttgatgggttttgcatgtctctatttcctttatttccactctgattttgttctttgttttttttttttttttttttggcttctgctatctttggggtttgtttcctcttgtttctctagttctgtttctttcctcttgtttctctagttcttttagttgagatgtgaagtttctaacttgtgatctttctagtttttgatgtgggcattgagtgctataaatttccctcttaaccatgccttacagcatcccagagatgcctctttatactcattagtttcaacaaactttttgatgtctgccttaatttcattatttacccaagagtcattctggaagaggttgttcaattttcatgtaggtgtgtggttttcagtgaatttcttaatattgagttctaatttgtgctgtgatctgagagactgtttgttatgatttaagttcttttgcattcactgaggagtgttttactcccaattatgagatcaattttaaagtgatgtgtggtggtaagaatgtatattctattgaatttgggtggagaattctgtagatatctatcagggccacttgatccagagctaagtttagatcctgcatatctttgttaattttctatcccaatgatctaatattgtcagtggaatgttaaagtttcccattattattatgtgggagtctaagtctctttggaggtctctaagaacttgctttatgaatccaggtgctcttgcattgggtgcatatatatttaggatagttagctcttcttgttgaattgaagactttaccattatgtaatgcccttatttgtcatttttgatctttgttggttaaaatctgttttgtcagaatctaggattgcaaccacttcttttttctgttttctattttcttgctatcccttttcctccatccttttgttttgatcctgtgtgtgtctttgcatgtgagatgggtctcttaaagacagcattacaatgggtcttggctcttcgtccagcttttcattctgtgtcttttaattgggtcatttagcccatttacatttaaggttagtattgatatatgtgaatttgattctatcatcattatgctagctggttatttttcagacttgtttgtgtggttccttcatagtgtcactggtctgtgtacttcagtgtgtttttgtagtagctggcaacggtttttcctttccatatttagtgcttccttcaggagctcttgcaaggcaggcctcatggtgaagaattccctcagcatttgcttgtctcaaaaaaaaattctccttacttataaagtttagtttgtccagatatgaaactctgggttggaatttctttcctttaagaatgttgaatattggccccaatctcttctggcttgtagggtttctgctgagaggtccactgttagtctaataggttttcctttgtaagtgacctggcctttctctccggctgtccttaatattttttcttccatttcaacctgtgagaatctaatgattatgtgtctatggcttgatatttttgtggagtatcttactgggtttctctgtatttcctgaatttgaatgttggcctgccttgctaggttggggaagttctcatgaatgataccatgaagtatgtcttcctacttggttccactttccccacctctttttggtacctcaatctgtcataagtttagtctttttacataatcccatatttctcagaggttttgttaatttattttaattcttttttatctaatcttgtctgtctgtcaaatttcagaaagatagttttcaaggtctgagattctttcctccacttggtctattttgctattgatacttgtgagtgcgttgtgaagttctcttgtgttttttatctccattacatcagttatgtttctctctaaactggccattctggctatcagctcctttattgttttatcactttttccttcttagcattaggttacaacatgctcctttagttcagtgaagttcgttattacccaccttttgaagcctacttctgtcaattcagccatctcagcctcagtccagttctgggtccttgctcgagaggtgttgtagtcatttagaggagaagaggtactttggctttttgagttttcagcatttttgtgttgattctttctcatctttgtgggctgatctacctttgacttttgaggttgttgacctttgaatggggtttctgtggggtttctctgttgatgttattgttgttgttttcggtttggttgtttttaacaatcaggccactctactgtagggctgctgtggtttgctgggggtccactccagaacccagttgcctcagtttttcccatacctggaggtatcaccagtgaaggctgtgaaatagcaagatggcatccagtgtcttttctggaagcttggtcctgggggggtactgacctgttgccagcctgcattcacctgtaggaggtggctggagacctccattggaaggtctcattcagtcaggaggaacgggatcagggacctgcccagagaagcagtctggatgctttctggtagagcaggtacactgcattgcggtgaaccctttctcatccagaccacttatgttctccacagcctgcaggctggagcagctgactcaactgaaccacagagatgatggctacccctccccctgggaactcagacccatctcaggaagacctcaacccactgctgttggctgcctaggattccaagccagtggttcttaacttgtgaggtgacatggaagtagggcctgcagaacaatactgcttggctccctggattaagctcccttcctaggtatagctatggttggctttcatgccttgctaggaatcccagggctggagtatgtaaaactcccagtctctgtgtgtgcctgagtggctgctctgctgagactccacacaactctgtttatcagacccaaagccccggtggggatcacctcataggggatattttgatccatgggttgcaaagatccatgggagaggtgtggtttcctgggcagggttgtacaatcacttactgcttcccttgcctggggatgggggttcctttggctctctgctactccagagtggaacatacttcacctctgacttttcttccttcttcgtgggtcaggttgtttgcctagtcaatcccaatgtaagaacctggatatttcagtcgaaagtgctgaattcactcacccttttatattcctctccatgagtgctgcagaccacagctgcttctaattggccctctgggtcaatgaataattgattttaataaaaaacacaaatcagtttctaagcagaaggtggtcgaacaactattaaaatggtatttctatatgtttttagtccattattctgtgttactcctcgttacgtgatcttttttttttttttcctggatagccggttagacaaactgcactcactttttcttaccacaaaatctgagaagtaaagtatgtatattctagtgaatttttcttgtctacctgcatgttagataaggaagaactacttgacacctttccatttttaggaaatcactttgtagtccttacactttactgtgtgtatctatcatctagagaggctttttaaaatttagaggtacacgtacagcctagagttcagaaatattctagtggggtctagtgatctggtagtttaacaggaacataagtaagaagcttcatgtttatctaaattcaggcatttatcttcgttctatatctactccaagtcttaggtcagtttcagtcataatctgtttatctccaatgcttaagtctaaggaatgtgttacccagcttgttatgctgtattcacattgacatggtgaaaaccacatgcatctgaataaatcattagagtttgtggaaaaatgagctgtgtttttggaaacagttttgaagccttaactcgtcactaccagaaaatgggaaaccaggttgagagcctttggttttagtgagaaacagaaggttgtttgttagaaatggaatattatctcattaaaataattggataacggggtgtcttctttatgcaatgacaatattatactcacagtatacttactttgtgaatcttgttcatttcaaagtaaaaaataatatatgacatttttaaaaattttgtttaaattggatattctgtatacctgaaagtttcagaaagaaacacaaggtctaaacgatatgcttcattgatttttggatttttatggttaggtttcttgactccattaaatttttaagttttgatattggcaacagcagccatacttctttattcccaacttcttacatgctactttttttctgattacaaccatctttgatgtgtgaatatatagaaaatagctattctagcatattaacagtctctatctttggctatagcaagaagtcagaaactcagataatttattttcatttaataagcagttagtatatgatgaatgcaggtgaaaataaatcagctcgtatattggaaaaagatgttggcttaagcttattttttttttttgtctccagaatcattgaggccaaattgaatcccatttctgcctcaagaaaataaattgtccactatagtctccagtataggaataatttgtttgtttgtatatgatatctgggattaattcagcacaaatgtgacacttactaggctagaatcacgctaaacaaagataccttaggcaccatccctgttgtcaagcatattattgcccagtagaaggaaaaaggaaaattaaaggggaaaaactactttacagtgttgtagaagttattgtggaagtctatatatatttcagaggaaacacacaaaaaaaatgtattattaaccaagccagagctgtgggagtaagaataatgatgatgctattcctagagagacaacacctgagttaagctgtttgttgggccgtgttaaagaggtcaaggaggagcagagggattccaagggttatcaatctaaggattattcaagggtgattagcaaaggttggaaccaaagggggctataatgatcaacatttattgcatgcttattacatgccagtcactcaacaaagaattatttcttctaatttttactcaagcttctgagatatgtgatcttaggttcgttttaaagatgagggaaccaagacacagacggactaaataatattcccaaggtcacttaagtagtagatggggcttttcagaaatgcctacttcttgaatgcctcaggaatttctcagcatgagcaaaaagtgattgaataaaaacgctgaggtggattggctgctagaggctctatcactacagcctaccaaaagcagctcctctcacagatatcactattgacattttctctgccaacaatctgtgaggtctcacactgggtgttggaattaaatagagagacacttaagttttccatctttttggagacacaagactggtacagaaaagaaacataaaagtttgaagttacaaaatatgaagaaaataaaagatagaagttacaagatctacaaggccgaggtccaaacgaactgctcagcctaagaatgttatagtgaagagtaaagagtatcaggctggacatggtggctcatgcctgtaatccctgcacttggggaggctgagacaggtggatagcttgatctcaggagtttaagaccagcctgggaacaatggtgaaaccctgtctctacaaaaaaatacaatattagctaggtggggtggcacgtgcctgtagtcccatctacttgggaggctgaggtgggtgggtggattgagcccgaagggttgaggttgcagtgagctgtgattgtaccactgcactccagcctgggtgatagaacagaacaagattctgtctcagaaaaaaaaaaaaaaagaaaaagaaaaaaaaattaggagaagtgagtagtagagaaaaagcaaaagctttgggtgaccataaccctgggtttaaaatctggcttttccatttcttgactatataacttgtgaagtcacttaacaattctacggtatatttatttgctatgtgtaaaatataacaattataattgagtatcaattaaaatagtctagtatacagacaggcatacactctctcttcaatcaatgtcagtcatcatttttaatcaatgtactctactagacttccttatttctgagtaagcatatagatacatattctggagtatgtaggacttacctcaaccttaaactcagtgtttgccaaatgttttcactttttaaatggttcttggatattattttttagattctcgaaagtacttctgatagagttgttatgggttgattcctgagtcaggattggattctaataccagagcagtgctggttcaccaaatgagccacctttattttctttttaggaaggcatcatggtgcagtaggacacgccctaccatttctgctgtgaagcgttaatttcctaaagcatgacttgagaccagtgacacctgcctttcaaggttcatgtagggattgaaaggtggggtgtgtgaaaggcatagaaatgtgcattttcataccataggtgctcgatacttgttcctttccttctcttccattccccactcctgggcttcagttgcaaaagctataaaataaaggggcgaggttttaagatttctgaagtccccactagcctattatgcaatgactgctgaatatctacttaaagcaaaggtgaccttgtcataaataatggtttgctgcacagaatgtctagctgttaatgtctccctgtctgtttgtaatgtattgctattaggcctcggtataattttctttcctgtcattttttccctctggcctttcattaatattattcacttgaaaatacttaatgtaaatcaaattgctctcaattggctttccaatgcaagaagacgcaaagttatttatctaactatggtcctagatttttaaatttagaccttaggaaatgggaggtatatgattaatctgcccttaaaattgtgatataggatggaaccttactagtgtgcttcttacattaacttcacaaatctgtggacagttgccttgttcagcaatctttgtatcatttcaatattttcttgaaacagctttgaattttgcttttgatgtttgcctaactagtcaatacaagcttcattaccattgacaattaactgcaattacttctagcatgtatagccaaatctgtatgtgtggtcaatcatctagagctaattagaagtatctgctgcttatggggctacaatatgccatttttggttagtgactacttgtggaaaattgttattaggtttctgatacgatgcaatgtgattgtatttgcctcaaatctcctccagccaggctgtttggttcactgataatttggatcctggtaaaatggcctaaggcttatcctgaggctttgtaatcatatctctcactggctctgaatcctgcaagcccattcagcctgtgagagtccacagaagaaaagatacaatgccttctatgaggaggtcaccattgagggtcgttatgagaaaggcctggctctgtcatttccagtcaccctgaacttaatccagcagtgaggcaaattatttggcatgagaagtgtggatgtcctagatgtttggaaactgagattgagataaagttccattatactcaggttatgaaaatatcatctgctcaccactttccccttccccctagaatcttgtactagtaaaacctgaacataacatgaagtctatcgtgtacccagtttggtgccaagtagtggcaacttgagtagatattttctcttgatattttcctcagagctttacacatttacttgcctactggattcttacagaagaagtgagatggtccatcaccgttttcccttaaaactgtgggtcctgctgtaatagcccatgcaagaacagacatggggtttctataaaacagggctaaatggcaattctgttggaaggagagcctaggagagtctccttgaaggtatattttcatagcaatctcgctgtttttaaatgcaccttttcagaagttgatagaatttgtcgggggctatatcctctctaatactagtccttgatgccatttctgcatgaagaggagctgactggagcttcctcctcgtcttgtttctgcttcatctattctgactggggtagggggtcttagatggtagagcctaccaacactctgtagaagcagttctgtaattacttttacacttcccagatggcatcaatattcccaaatgggcttgttaaaaatgcattcctcacacccacagattctcaaatagaaagcctgaggtaaggacagaaacattccttttctacaaactgccaaagagaaactaagataggtgttccagagaggtcgtactttgaaggactttctctgtgtaacatgatttctccctctcctcataggctcttcatagaaaggaacaataaatacctggagagtcaccaagagaggatatgagactcccagttgctaagtatcagctctcccttggttagcaaattaaagcaggtggtattatggaaagaacattggataagaggttagaaatttggatcccagatttgactccactccctagtgttatcatctctagccattaatgtaaatttcctaccgtcttaagtttccttttccaggcaataataattttgataatattattcctgcttatttcagaaaattgttttttataattttgatgatattattcctgcttatttcagaaaattgttttgaggagcaaataagataatggctatgaaagtgctttataaagtattatgcaaatgtaaataattattattacacctttctagaattagaaatgatcagagattgaactacatgaccacctagatcttctgcagctctaatccctattattaggaaaggggttacacaaatgtcattcaatgccacgcttttacagctatttaagagtctataaatatctgtggcacagcctaaccttccttccacttcaccgcagctgaacatggtaatcagatggcagtgggggtggttttcatgaatttcttttactggggtagatatcttgctgggccacttccatattgttttaaatgtgtttgcttttattaaacaggtgtatgttcctgttgctgcttgtctacctttctctgcctccattatcctcacaggtggatctatttcctccaggaaatcctctcttaaccctcccacccacacacaccaccagaactttgagccactactgctttccatgtgcgctcagtacttattagagaactacctcactagaaaataaattacttgatagtatagattagtatagtatagattatgtcttgcatatattattgaagaactaccttactagaaaataaattacttgatggtatagattaatatactatagtatagattatgtcttggtcatggtctaacccctgcacattttcatggcacattgtatgtgtttgataaggagtgaatgcatgaatgtaagaataaatgtcaaaggaatcccatgtataggttcaaatatttacagtttttgagttggaactgtaaagactttcctggcagaagcaataagaatgtcagaagtctcagccccatcaaatgaagtttagcaagaagtctaatcactgtaggcctaaacctgggagtgagattactgtgttgctacacctaccgaagcaggtgccctattgcaaccaagttgcaatatttcattctccctactgtactggtccagttgcaaaagtgaatttttgcttcatttctgtactctgtagtttgcctgattatcttcatggtattccagaccagtagtgtcagctggtcctgactagccacgctgatatttgttattttcatcataaatatcatttaattacctaccagtgaactcctcttaagctgtggttgccgcctagtttcccaactctttgtctgccttctatatttgactaattaattgctacaggtaaagctgttcttctatcctgaacacatagtatacaatcctaatctactatagcagtgaacatagcaggaagataccaccaacagatcccatttgggctatgatgggaccgtattctggtatatctcagattgctccaccatccttactaggacttacctctgtggctagataatcttcctccaacctgccaaatcctttactcttggaagcaaattctgcttaatcctagcttccttcaccatctcctggtcccatgatgctgagatctgagcatgccttgtgcacatactggctttggttgaagatgtgctaatgatgagagagagaaaaactactcctgagtctcacgaagccttattagattaaatttattatttttgttaacagcatggactctaaagccagattgctgaggtcctaatctcaactctgtcactctggtggagtaatgtgggaaggttacctaattctcctgtgtctcaacttccttatctttgaaatgagtatggtaacactaccaacttcttatggttactatgacaattaatagttgaaacaagtggaatactgagaacagtacccaactgaatcttaaacatatattctctaaaaatatatgtactgctccaagatatatttaatagtcttattaaaatattagttgaacaaacatccatgagtcaataataagaaaggtaaataactaaatataaagaaataagggaggcaatagaaagctattattccccatggcagaatttgaattagtgagtatagaaaaagttaaaaagatggaaaaaaattatcctgtggtaaacaccaaaataatagtttcagtaatcaataactgctaaaattagtgtgtggaagtaatgagaaataggatattttcatattctgaaagtattctacaatgtacttagccattacaaagtaaaaatagtaaacttatactggagaaactcgataaaagtaatgttagccaagtgatcaaattgaacactaacataatgagacaaatcagtgtcatgagcttctttatataatgtcccaagaagtctcaaaataacttctgttgtgttcttactataaatgcctaatctacatattaaatataatcaggagtaatatggaacaaaccaaattgtgctatattctgtaaaacaattagccagtgtattagcccattctcacactgctatgaacaattgcccaagactgggtaatttataaaggaaagaggtttaattgacccacagttccacatggctggggaggcctcaggaaaccgacaatcatgatgtaagtagaagcaagtaccttcttcacaaggtggcagaaaagagaagtgtgagcgaaggaggaacttgccaaacacttataaaaccatccagtctcgtgagaattcactcgtgatcacgagaacaacatgggacaacccgcccccataatccaaacactttccaccctccccacgtgggaattacaattcaagacgagattttggtagggacacaaagcctaaccatatcagccattattcttcacaaagtcatcaaaaacaaagaaaggctgaaaatctgtcctaaattaaaataaatgtaagatgatacaataagtatatggagtatatgatcctgaataagatttttgcctatagaatactttagtggggcaattgataaactttgaaaaaggtcaatggattagttaatagtttagaaatggtgttccctggtgttgaaaaactgtactaatttatgtaatatgtcaacatttggtgaattcgagtgaagaatgcataagaattacgcattagtgagatttttgtaagtcttgtttaccatatgccaaggagagaatagtagttctagctctacgaaggttacagaaagcaaacataggatttataagcccaagtgcttatagtctagtaaaggatataaaatgacaatgtaaacaatgctatgtgctatgaaatacgtaattttaattttatggaaattttggaaatatagaaatgtattctaatggaaagtgaaaaatatacttcatgaccaaggcagcattttagccacacattggatgacatctggaattggagcatgtaaagataggcgaagaagagagtgtaagaaacgcgtgaccaagagccaagagcagttgatttcaatgaaaggttcaggactggagcattgggtatttgtagaaggctagctgggcatgagtattgagatttcattagggaaagtgttgaaagcaatgacaaaatgtcatgatttcattcagtagtccgtaagaagccatggaagttttttgggcaggataatgtcaagattggtaaacagagatgtataagagtgactgtgttagatgaggtggaaggaaggatcagggcatatccattgaccactttatgtgatttaaacattcaacattaagagaagaagtattccacaggtatttgcattgctttcttaactgtgaaatagttgttcatgtttaaatggactgattaagaatcatgaactcagagctcttcacatttgcagaagcagatggtggaattaaagagacctcttaatacattttttacccagcttttcctacaatagatgggacagttttaaataaaggcttggatgtgtatacatatttaattataacaaaatttaggaaatgcagcatttcaagtgcaattctgtaatctgaagacaacatttttctgtggttctgatcattgattttcccacaacatttattaaatatttatttattgcacaaatgttgaaatgtgtttcttaagttaccagtttatataatcttttttcactctattctgccacatattataataaaaatagattttataattgtgctaaagtacaaataataaaataacataaaatacagaaacatttcaaaaaattcttgtgatttcaatcatttagccagactcaaactgtcttgcttcaaaaaatactctctgaatacatgaattttaaaaatctattttcactagatgaaatttcacaactgtctttattctagtttattcattttcacatctatctttcaaaaacattgtaatcatgaattgtatacttgttggaaaggttcatgaacatgataattataggattgtataactgctctcataaagtttccaaatataacttgatgacatttaaaaagttattttaaagctaaatttcagtttgtcttttaaatctgtttaaatggatcatgcatattgtagtatagatagatgtgaaagaagattagatgtgataaaaatctatggccaagatgagcctgcttaaaatcatgacaagctccttcccttcctttttattttctaaatatatgatgaaaaaatatcacaaaatgttctgtacaagactctcatgtaactattttgttgttgtctccatactggcatgtcagtacagaggacagatcactatacttgggcttcaaaaaaatcagtaattattgttccattcataagcattatggactctctgaggttcaattttcttatttttgaagcaagaaattacctgtaaaaacttagcccataaaagatgtttaatacatgttatacagtcctgaatttcattacttttaatcaacatttaagtgttcattgaatacctactggattaaagcaccaagcctcccagagaaaaaacactcttctttacttcaacatagctgtagaggctacacatgcagggacaattcaactcttacctctgtctgtgaaaaggttgagacctagatgtgtgccctgatagcattatactgttaaaggagacatccacaatgaaatctgtgtctgagcataagaagcagtaacttatgagaatgtatcatcttcattgaagacatgaaatcttttcatagtgtgagctttaagttgcaggtacacctaggtctcaacacagtatgtgtgattcaatttctccttcttcctctagtgacctccttcttcctaatcctagattctataatcaatttgtttagataacttactggtttagcacttaatctgatctatccactgcatgtatttcctagatgaagggacagacttggaggctgtgcgacaagcctgctgaggcacagcacgggaaacttagcataggggtcagaccttttccaacacttttcttgtcaaactgagctgcctcatttttagtatattgataaacagttcagtgtccctagtataatggctactgataccatgaaagtggcactttaatcttgtcatggtgtattacagtattttcctgcaagggattacatggcagagaatcagtgaattatccagaatccccttcaattcccatcctgcagggaaatgtgcctgagtagaccagctggaggcaccatgaaaaatgccagcaaagcaggaccccatgcccctcacactcacatatttgtaacaaagttggaaaggaaatcagggaacattaactctactatgtaataagagacatttgttggttgagaaaatagcctttttagtaaaggtgggctccaaaattcagttgctggcatcaacctgccctgtttttgagttgactaagatatacacatctagccacttgcaaagagatacaaaaatttgggagaaaacaagcctccaggaccttcagaacttacccttctttacctgagtaagggttggataatcataaaatcaatttgcacattaaaacacaaagatcccgcagaagtcagtttctgtatccaaaaataaagttaatttcatgtaaacattaggcatccgttactttcaggaaagttttttttaggtttgttgcatttctgtgtacttgaggctgaccttatattttgtaaatgttaaaactgaaattgtcattagaaatcatagtgttcaatacctttaactgagactaaaagtggtgaacaggtttttctaaggacataaataggttgaccacaaatgattatctaaatgattgtctaaatgaccacaaatgattgtctaacttcgagagtgctcagaagtgttgtaactctgggagaacaatcataaaaggaaatgtcacaggaaaacataggccatatggttgctccagcatagaaataattaataattatatcttttgaatttggttatcaattacacgagtacaccacttcatgatcttgggaaagagcctgtggctggctgtgcatgtagtgtatcagtagtgtgaaggacagtattaacgcagtcaatgtctcccgaacggtctgacattttgacatggtgacttcacagatttgagattaaaatgaaaggatgttgaattattttccagttataaattaatgggaagacagaatacacagacagatgtcaatgcaagtgtgtggcattgttcctaggtacaccctggggctgcctacctgcccaggatatcaggcgtgaaggcagcagacccatttcagatcctgtttaccagtcagtgggaaggaagccccaacctacttccaggatttccttggctcagagactgaggactaagctcactcctggggaagttattattgcagattgctatgtggagagaaagttggcaaagatgatagcaacagggacaaacaaagttttaccagtgtgaaaccaaacaacaaggtaatgggcacagaaaacgtttatcctgaaaactcgttttatttcatttttcagcaaaatgaatgttggcaaagctacatttttagacaaaatttactgaccacaaagtgccagagaagctgagagatttcatatcactgttaaagtaacagctatctttgggcaaatgaaggaaaagcccatgagacaggagtgagaatgtggtgaatatcatcatttaaaaaaataaaactaaacaatgtatttcttcgagttatataagatgattttattaagaatgaataactcaagtgttagaaaagcaggactagcttaagatcttaagataggtttattttgaattgtaaaaatcaaatgtgcaatctcaataagatgaaattagtttatgagtagattagagaacttatttattttaatatgttactatctaattaaaatactaatttagcaaacccagaatccatctatgatgtctctccttggtcagctagcacagccatctggttaccaaatattgttgactccatctctggaatccatttccaattttccatattcattgtcaataacaaacacttaataaatccataattggttgtctttgtttagcacttactgtaccaagtgttatattttgaagaaaaatgatacacagaattttgtcactagcatctgtgacagacagaaaatgatgaaaatattctgtaatctaaaaagttacaaagttacagcatgttaagtaactgtaaccaagagaatttactattttgcaagaaaaaatttaaaatagaagatatttggatcaacttatgttgtaactgtttcctgaacttcagtcattcatttattggaaataattggctatagtgaataatgttgcaaaaaacatgggagggtgggtctctttgagatcttccttacaatgcttttagatatatatccagaagtaggattgttgtattatatgatatttctgtttttcatagctactgtaccattttacattcctcccaacagtgtacaaggggtctaatttctccacatttttgccaacacttatctttttaaaacataataataacaggtgtgagatgatatcttattgtagttttgatttgcatcactccgtaatttgtgatatggagggtcctttcatatacctattggccattagtgtgctttctttggagaaatgtttatttgctcctctgttgtttaggttatttaattttttgctactgaattgcaggaattccacctctaagtgaaaaacagcaattttataaatataagttaattataaaaatgcatgactattgaaataaaaatattcatcaatagtgacctaaaataatcttgtatattcccagcatcccttacgccatactttggtaaatactgttcatggtcttagaaatgccaagcaagcagacagcaggaaactagtgatctagaatcagcaagaaacctctaaggtaagggtgggattggtcatagaccctctttttccctatttttctctcactactgcattttgttttcatgaatgccaactgcctttctctaaagtttattaatgtccttgcactcccctaggacaataaacagttacaagaataaaatttacacgttctcgagaagtttatctgctattgtataacataaagaagcagagaaaatgtctagacctgtgggtcaactctcagaaatcttaatatgtaaccacaaagactgctattttcagcttcttaattttcacttgttaatgtgtctaaaactaccatagcttaaataatagcttgcaatttctgaaaacagaaaatctcatagaaaattcgctgggttttcaaggtatgccatattaagacaactcctagcctccaacatgcttaaattgaaaagagataattcagagtccggaacgtgggttccatccctcacaatgcatagtctgagaagtatttgatttcactgagtctcatatttcatgtatatatataaactggaaaaattatttcttatctcaacctgtatatttttatcaggatttccagaaccttcccaaacagattagaggatgatatatattttaagttattcaatgactgactctttttaattggcagctgttatactcaagatattatcttagatgctggggataagcagctaagctaagctgaatttgtttccactttcaaaaagcttctaatctagtgacgagaataatgcatcaatactcagagaaactacacgttatagtacaaggtagagttctatcctatagaaaatgaatttttccatttgctgttataattaaatattgataaatagatttattgggtcatgtctatgaaattcatttagcaagatcaatagattgtgctataataaaagtactaaggaaattcataaacaaacggaaaatgcactgaagaaatcattgctttgaaagtcttctttggcaagagtcttaatttaaggcatctatccctgccactcagtcctggaaaactatagccaagacaggacatccacagtctctagggcagaatgatttctatctaaccagaggggtgggcaggggacagtcaagtggatggaaggagaccttgtaatctgagccaataaaattttgcatggtaaagagtatttttcactccactaacccttaatcagaagtctctttatcttctttcttcatatattcacactcattctgagtatttttcactttaagtcatattctctgaacagcaggaaaagaaactttgatatcagaattatcttaaatttataatccttttctctaaattcaagtgtcctcatctgaaaaataaggcgattttatttacaaatttattattgttgtgaaggtgtgacaagataacattgacaaagtccctcgtgcccagcacagtgtgtggcacatcatagaagttcagcaaacgtcagttccttccccagagtcaaggttaattatatcttgttttcaaatattgcaattttttgttttatatatttatgacatttattaataacactacaactcaactaattcctttggacataggttcattggttcattcattcgaaaaacattaattgatatgtccatgggctagccactggattagattcttgaagtgtagaaattaataaagtaatcttgcattcagggaattttcagtcaaacaggagactacgtttcaacaattggttttagtttagtttgctaagtgctatgatagagacatgtacagtgtgtagtggggctcagagaaaggagtggtcaaagttggtggtaggcagggatgtttcaaagagggattggatgaataattattacctcaattagtgaaaaggacactagaatgtaatccaagagactctggacaaatcttacttttgtggtcatttttgcaaggcatcatttatactgagcattgattcaatggtcttaggtcagctcagcctgcagctggaacacaccctttttatagcctaaaaggaataaattctgatagctgttcagaaagtcagaaaatacaattttaaataaactattaggttatctaggatgaacaaaatggatgctgtgattgttttggtaaactactcttgagcaaatctgacacatcttaatactggtttaccttgatctttcagttaatttctgtaaatataggtcaggtggctactccaggccaggcaccttgtaatacactggggatattgcagttaacaacaacaacaacaacaaaatcccatcaataatgtcactcctagtctcaagagtgataggaagataaaccaaaatattccagtgatgttggttgaacttggcaagtgattcactttcttccattaaacatttgttgaacatttgcaccatgatgtaggactacacagagtgatgtgacggcatagagatataattggtctgcactggtgttcaaagaaggcttcttgaaagacgtgaggtctaaggtgtatccaaagaatcaaaggtgatttgtcaggcaatgggagtgcgcttttcaagcagtagaataatactaagcaatgccatggagctacaaaacagcatgatgcctgtgggtattaggaagcagtttaacattactagagactcatgtataagtagaagtggtgaattatgaagctggagaagtgggcaggaatgaagtcatgaaaaccttgtccatatgataagtgtgtatcataaaggactttctcagctttctggagccattaaaaaaatggcattttttgtggataatagaagtttctgtttgcagtagtgcattaataaattgctcttaattcatagtaactactatccagaatggtaatatttatgtttttttattatactttatgttctgggatacatgtgtagaacgtgcaggtttgttacataggtatacacgtgccatggtggtttgttgcacccatcaacccatcatctacattaggtatttctcctaatgctatccctcccctagcccccgactccctgacaggccccagtgtatggtgttcccctccctgtgtccatgtgttctcattgttcaacttccacttataagtgagaacacgtggtgtttggttttctgttcgtgtgttcgtttgctgagaatgatggtttccagcttcatccatgtctctgcaaaggacatgaactcatcctttttttatggcttcatagtattccatggtgtgtatgtgccacatttttttatctagtctatcattgatgaacatttcggttggttccaagtctttgctattatgaacagtgctgcaataaacatatgtgtgcatgtgtctttacagtagaatgatttataatcctttgggtatatacccagtaatgggattgctgggttaaatggtatttctggcactagatccttgaggaattgccacactgtcttccacaatggtttaactaatttatattcccaccaacagtgtgaaagcattcctatttctccacaccctctccagcatgtttcctgactttttaataatcgccattctaattggcatgagatggtatctcattgtggctttgttttgcatttctctaatgaccagtgatgatgagctttttttatatgtttgttggccgcataaatgtcttttgagaagtgtctgttcatatccttcacccactttttgatggggttgtcttttccttgtaaatttgtttgagttctttgtagattctggatattagccctttgtcagatgagtagattgcaaaaattttctcccattctgtaggttgcctgttcactctgatgatagttccttttgctgtgcagaagctctttagtttaattagatcccatttgtcaattttggcttttgttgccattgcttttggtgttttagtcatgaagtccttgcccatgcctatgtcctgaatgctattgcctaggttatgttgtagggcttttatgattttaggtcttacatttaaatctttaacacatcttgagttaatttttgtataaggtgtaaggaaggggtccagttttagttttctacatatggctagccagttttcccaacaccatttattaaataggagatcctttccccattgcttgtttttgtcaggtttgtcaaagaaagatcagatggctgtagatgtgtgatgttatttctgaggcctctgttctgttccattggtctatttatctgttttggtaccagtaccatgcgttttggttactgcagccttgtagtatagcttgtagtcaggtagcatgattttccagctttgttctttttatttaggattgtcttggctatatgggctcttttatggttccatatgaattttaaagtaggttttactaattctttgaagaaagtcaatggtagcctgatggggatagcattaaatctataaattactttgggaaatatggccattttcacaatataattcttcctatccattagcatggactgtttttccatttgtttgtgtcctcttatttttttttttgggcagtggtttgtagttctccttgaagaggtccttcacatcccttctaagttggattcctaggtattttattctctttgtagcaactgtgaatgggagttccctcattatttggctctccgtttgtctgttcatggtgtataggaatgcttgtgaattttcccacattgattttgtatcctgagattttgctgaagttgcttatcagcttaaggagattttgggctatgatgatggggttttctaaaaagacacaatcatgtcatctgcaaacagagacaattttacttcctctctacctatttgaataccttttatttctttctcttgcctgattgccctagccagaacttccaatactatgttgaataggagtggtgagagagggcatccttgtcttgtactggttttcaaagggaatgcttccagcttttgcctattcagtgtgatattggctgtgagtttgtcataaataacttattattttgagatacgttccatcaatacctagtttattgagagtttttagcatgaaggggtgttgaattttatcgaaggccttttctgcatctattgacataatcatgtggtttttgtcgctggttctgtttatgtgatggattgtgtttattgatttgcatatgttgaaccagccttgcatcccagggatgaagccgacttgatactggtggataagctttttgatgtgctgctggattcattttgccagtattttattgaggattttcatgttgatgttcctcagggatactggcctgaaattttctttttttgttgtgtctctgccaggttttggtatcaggatgatgctggccacataaaatgagttagggaggagcccctctttttctattgtttggaatagtttcagaagtaatggtaccagctcctcggtgtacctctagtagaattcggttgtgaatccatctggtcctgggctttttttttggttaggctattaattatggcctcaatttcagaacttgttattagtctattcagggatttgaactcttccttgtttagtcttgggagggagtatgtgtccagaaatttatccatttcttctagattttctagtttatttgtgtagaggtgtttatagtattctctgatggtagtttgtgtttctgtgggattagtggtgatatcccctttatcattttctattgagtctatttgattcttctctttttttcttttttatgagtctgggtagtggtctattttgttaatcttttcaaaaaaccagctcctggattcactgatttttttgaagggtttttcatgtctctatctcctttagttttcctctgatctaagttatttcttgtcttctgctagctgttgaatttatttgctcttccttttctagttcttttaattgtgatgttaatgtgttgattttagatctttcctgctttcccctgtgggcatttagtaaatctccctctaaacactgctttagctgtgtcccagagattctggtacattgtgtctttgttctcattggtttcaagcaacttatttatttctgccttaattttgttatttactcagtagtcattcaggagcaggttgttcagtttccatgtagttgtgtggttttgagtgactttcttaatcctgagttctaatgcactgtggtctgagagactgtttgctatgatttccattcttttgcatttgctgaagtgtgttttacttccaattatgtgatcaattttagaataagtgtgatgtggtgctgagaagaatgtatattctcttgatttggggaggagagttctgtagatgtctattgggtccgcttggtccagagctgagttcaaatcctgaatatccttgataattttctgtctcatcgatctctctaatattgacagtgcagtgttaaagtcttccactattattgcgtttgaatctaagtctctttgttggtctcttagaacttgctttatgaatctgggtgctcctgtattgggtgcttatatatttaggatagttagctcttcttgttgcattgatccagttaccattatataatgcccttctttgtctcttttgacctttgttggtttaaagtctgttttatcagagactaggattgcaacccctgatttctgttttccatttgcttggtagatcttcctccatccctttattttgagcctatgtgcgtctttgcacatgagatgggtctcctgaatacagcacactgatgggtcttgactctttatccaatttgcctgactatgtcttttaattgaggcatttagcccatttacatttaaggctaatactgttatgtgtgaacttaatcctgtcattatgatgttagctggttattttgcccattcgttgatgcagtttcttcatagtattgatggtctttacaatttggcatgtttttgcagtggccagtactggtttttccttgccatatttagtgctttcttcaggagcttttgtaaggcaggcctggtgatgacaacatctctcagcatttgcttgtctgtaaaggattttatttctccttcacttatgaagtttagtttggctggatatgaaattctgggttgacaattattttctttaagaatgttgaatattggcccccatgatcttctgacttgtagagtttctgccaagagatccactgttagtctgatgggcttccctttgtgggtaatctgacctttctctctggctgctcttaacatttattccttcatttcaacattggtgaaactgacgattatgtgtcttgggattgctcttcctgaggattatctttgtggtgtttttgtatattttctgaatttgaatgttggcctgtcttcctaggttggagaagttctcctggataatatcctaaagagtgttttccaacttggtttcattctcctcatcactttcaggtacaccaatcaaacacaggtttggtcttttcacttagtcccatatatcttggaggctttgttcgttccttttcattcttttttctctaatcttgtcttcacattttatttcattaagttgatcttcaatctctgatatcctttcttctgcttaattggttagactattgatacttatctatgcttcatgaagttcttgtgctgtgtttttcagctccattaggtcatttatgttcttctctaaactggttattctagtcagcaattcctctcatcttttttcaaggttcttagcttctttacattgggttagaacatgctcctttagctcagaggagtttgttactactcactttctgaagcctacttctgtcagttcatcaaactcattctccatccagttttgtttccttgctggcaaggagttgtgatcctttggaggagaagaggcagtctggttcttggaatgttcaacctttttgcactgtttttttctcatcttcgtggatttatctacctttggtctttgatgttggtgaccttcagatggagttttttgtggacatcctttttgttgatgttgatgctattcctttctgtttgttagttttccttctaacagtcaggcccctctgctgcaggtctgctggagtttgctggaggtccactccaggccctgtttgcctaggtattaccagcaaaggctgcagaacaggaaaaattgctgcctgtttcctcctctggaagcctcatcccataggggtacccaccagatgccagctagagctctcctgtatgaggtgtctgtcgatccctgatgggaggtgtctcccagtccagaggcatgggggtcagggacccacttgaggaggcagtctgtcccttagcagagcttgagtgctgtaatgggagatccactgctctattcacagctggcagccaggaacatttaagtctgctgaagctgcgcccacagtcaccccttcgcccaggtgctctgtcccaaggagatgagagtttgatctataagcccctgactggggctgctgcctttctttcagagatgccctgaccagtgaggagtaatctagagaggcagtctggctacagcagctttgctgagctgtggtgggctctgcccagttcaaacttcctggtggctttgtttacactgtgaggggaaaaccacctactcaagccttgataatggtggacacctctccccccaccaaacttgagtgtcccaggtcaacttcagactgctgtgctggtggcaagaattttaaaccagtgtatcttagcttgctgggctccatgaggatgggatccacttggctccctggcttcagccccctttccaggggagtgaatggttctgtatcatggcatccaggcattactggagtatgaataaaaactgcagctagctcactgtctgcccaaatggccacccagttttgtgcttgaaacccaaaaccctggtggcataggcacctgagggaatctctggtctgcgggttgtgaagactttgtcaaaagcgtagtatctgggccagaatccaccgtttcttacagcacagccctagcctcccttggctaggggaaggagttccccaaccccttgtacttcccagaagaagtgatgccccaccctgcttcagctcaccctccatgggctgcacctactgtctaaccagtcccagtgagaagagcaaggtacctcagctggaaatgcagaaatcacccacctgcattgatctcactgggagctgcagactggagctgttcgtatttggccatcttgccagccacctacgtttgttattatccatccattcatgcagtaagtaagtacttattaatatattacaatgccccatcactattactggtccaaagaataaactagtgagtaaaatagatgcaaccctaccatcacaaaacatactatctagagaagaagataaatatcaagttaagaactgtgcaataacaccatggagggcacagttaggagtaagtatatggagtattgggaagcaagtaactttaggacacagtgtaagcagagtggcagggaccgacggcctcctgagaaaaggtcagtgcagaggagacctgaagaaagaatatgattttaacaggtgaagattgggtaagaaagaagatacctttccactatcagggatggtatgtgcttaggctcagtggcagattagtaacaacactcatgtggaatgagaaggcagccaatagagatgagttaaactaagcaggaaagaaaatggtcaaagatggatctggaggaataggtagctacgagcacatgtaagtcctcatagattatattaaggatttgaactatctcctaagagagtttaaatttggattttcatttttaaaagggcattctcagtacctattgagtataatgttcactatttaggtaatggatatccaaatagaagcccaatccccagcagtacataatatgcccatatagcaacatgcacatgtactccctgaatctaaaatgaaacaagatttaagaagtaaagaataaataaataaaaagggcatcctggctgccaagtgaacaaagagcctgaagtgatgctacaagagtaagcatgaggttaaagggtcctgatgcctggctaagataaggatcatgctaggagctatgaagagtgatggagtgagtacacaaaggttgacactgctgtttaaaacctcaatgataaggggaaggaatgttccacagtgaaaagttgttatctagttgcttgagtgttcagaggtttcccacatcttttgtagaactcatgtagcttaatgacctcttccatagtaacaaccatttgtttgagagacaagcaagaaaaaaagcatggagcaacaggaagtctcattgattgcttgtgggaattcgaaatggcatagccactttggaatacaaacgaacaaacagtttcctacataacaaaacatactcttaccatactatcaagcaatcatgcccctttgcattttgccagttgagctgaaaacttatgcccacacaaaaacctacacataaatatgtattcatgaatttattcataattgccaaaacttggaagcaaccaagatgtccttcagtgggtgaatggtataaactgtggcacattcatacaatagaatagtagtcagtgatgaaaagaaatgagctatcaagctatgaaaaatcatggaggagccttgagagcatattgctatgagaaaaaaaaaaagccaatctgaaaagactacatactgtattattcttaatatatgacattctgaataaagaaaaactatggaaacagtaaaaatattagtggttgacgggtttcaagggaggagggagcaggagaagaaggatgaatgggcagggcacaggggatttttagggcctgaaattttattgtgtatgaggctataatggtggatacatgtcattataaatttgtcaaaagccatagcatgtacaacacagagtgaaccctaaagtaaactatagacttcagtcaataataatgtatcaatattgattcatcaattgtaacaactattctacaataatacaagatgttaacattaggggaaactggggatgaggcggtatatgggaaatctgtgttttctgcattattatctttataaacataaaactatgctaaaaatgaaaatctacttattaaagaaattatagcatagccatgaattgctggaaaatccaaacaaaacagaccattttgttatacagtaaacaatagtatatgtctagctttttgtccaggtatctcccttgtcttagtatataaagattgattgtgccagtccctcctggacaaatctgagagatctaggaagtagagcagctgcactgagatttctgcatgttatggcttctgaaatgtacaaaagttaccataaagtaattcctctcacttccgagttctccctctgctcaacacttagagaagtgttgaaaacgcagtcacagcaagggccctgaggcaggttggagttgtgtcagaaagctcagcagattccctgagaagctacaaatggttggaggcagatttcacaccaggtcatcagggcatccttacagtgataccaactcatttttccacagttttagaggagtggtttaacagtataattctgctattccaccctccaataaaggctaaaaccaaacataatgccaaatatggttgcaggctaaatgcacaggtgttaattgttagtaattctcagccaggcaatgaaattttgaccaaatgtgaaccaagagaatattccattatttgatatttccttctcactgctttgctaattaatttagaaatgtgaattgaccaaatacccagtgtcgggccatgtgttcagcttgtgaaaattagatatcactagtcatttagtcacaccttacatccccagtctgtttttctggaaagaaattaagaagtaatgaggtatatcttcataaaagtgaacagtctttcacatttgcatccagtactgtggagaacaaaagctgtcttttcctttgtcaatttcttttcacatatttgatgatttcagtaaaagaggatgttcttatctatattcaccttggaggcataaaaacttcattactgagaggcataaaaacttcattactgaaagtgagttcatagataggatgtttttcacttatttccaaccatcagtgacaagatggagacttacccaaatggcacaaaatcaagttatggatgtgcatttgtaacagtatgaatctggagatgtttattcttgtttggaataattattaacatttatattaacagtataagcatgtatgattaaagtcacttatgaaagataatgctataaactgtaatattagactgtgtttttgtaaccaccagatacttggtaaacattagaaattaagaagagtggtctaacttttgtacagtttgcagtgctatattcttcagttaatagaatcaataaaatatgaaatagtgcattcttagttcaaattttccaatgatgcaggggtggctttaatgacaagatgcgaactcttccagggacctttctcaaccttgcactcccaccaaaaaagattgaatttctagaaaggagaaaaattagttgctcttttcatgatgaaaatattcactgttatagccaacgattgttgagtgtgctttgtatcaccatcgtggtgctaaatgtttttacatgtattctctcatgtaatctccctaagaatcctattttaaggttgtgtgattaccatatttttgcacctaaggagaataaatttcaggaaggttaaagaatgtacttaaaatcacacaagttgtaaagtggtagagccaggatttgaagccacatatagaaatgctacgtgatggctatcccacattaaccactgtgtatttatttttaaattatgaaaaaacacatctgagatattgtgaaccttactggattttgttgctcttgatagagactggttttgtgccaagcagtataaattcaatacaggcacacacacacacacacacacacacacacacacacacacacacagagtaatgattttcctgcaaacctgtgtgagtctgtccatataaatggcttttgcacagggcacataacaattttaatggagattagacagaaggacgctctccaatattatttttaactttttctaaaatgtgttcattttggataagctgaatatgtctccctattacagagaaaaaaaagtggccagtagctgtttttttctgcattgagtgttttcagctaaaactgttttgactatgatttgtggggtgaaacttcatagccttattcacccagttggtatgaatggcaggatcctgaacaggattttaaggtaaaaggctggctcgcaggcaactcctatctcaagttaccttgtaccagaggctgagagtggcctcttagcagattatttatatgtaataaaatgatgcttacttccaccttcacttaattgtctgcaagggaaaacatatctgcactcagtcataggtataaacaaacactttcccctcaaagctttttccagtgtattatcttaaaagttcacagccactcatttattgtcaaaacaatattcaaaaaagggcttagatggtgtatagtagagaccttccatttttcctgtcttccatgcatatctctgtgattttgtacgtgacatggatttgttcaacaactatcaattggatacctcctaaatgccaggttctgtcttcacgggacttttatattttagggaagagagtcaagcaataaagagtttctacaaaacaaaagacactattaacagagtaaacagacaagctacagaatgggagaacatttttgcaaactatgtatctgacaaaggtctaatacccagtatctataaggaacctaaacaaatgtacaaggaaaagacaaacagccctattaaaaagtgggcaaaggacatgaacaggcatttttcaaaagaagacatgcatgcagccaacaattatatgataaaatgcccaacatcactgatcattagagaaatgcaaatcaaaaccacaatgagataccatctcatgccagtcagaatggttattattaaagtcaagagccaatagatgttgatgaggtttgggagaaaagggaacccttatacactgttggtgggagtgtaaattattagttcagcccttgtggaactcagtgtggcaattcctcaaagacctaaagacagaaatgccatttgatgcagcaatcccattactgggtatataccccaaaatatgtaaattattctgttataaagacacatgcacatgtgtgttcattgcagccctattagcaatagaaaagacatggaatcaacctaaatgcccatcatgatagactggatgaagaaaatgtgatacatatacaccatgtaattatatccagccataaaaaaggatgagactgtgtcctttgcagggacatgggtggagctggaggccattatcctcagcagacacaggaacagaaaaccaaacactgcatgttctcacttataaatgggagctaaacgatgagaatacagggacacagggaagggaacaacatacactgggtgtttcagagggtggagggtaaaaggaggtagagggttagtaaaaataactaatgggtatcaggcttaatatctgggtgatgaaataatctatacaacaaatccccacgacacaagtttatgtaacaaacctgcacttgtacccctgaacttaaactaaagttaaaaaaaaaagtatgtcagatgataataaatgctaaggagaaaaatataagagggaaggggaatagtgtttgacaagggatagcatgaggcaattttagatagggtggccaaacatgcttcactgagaataacaaggagaagacaaaacaaacatttaatcaaaagtcaatttctcagtgaagtcttttacagaatctgtgacttatttgagaaaggattccacgtgcatgttcagttgttagccaatatatactatgagttaagcctttagtctataaaggtgatttagactctgtgctttcactcacattatagaaaattatagaaaaatttcatgcagaatgtgtaggtatagaagcaaaatcaaaatggaaactaggaagatagagaagtgaactgagcctatgaggaattcagggaggctttagaaaagaggcagtctttgaacaaaggattaaaagatgacaatgcctaataataatatctcaacttttctgtagagaacattttaataaaatatgtttcctcctcttttgattttaaattatataagtaatatatgaatacatttgcactgtaaaactttgaaacagaaagcatagagtaaatgtgaatgttatacaccactcttttaattccactgtctctaaagcctggatcatctaatcactttgttaaactgaaaatagagggaggaataggtgaaagaagatcacgtatttgctctacaaatatacattttaaaaggcttactgtattgtaagtactgtgttaggaaaattggatgccagagttaagatgatatgacctttgctctcaaaaacattatagttttgtgattgcaggcaaatggaatcacatatataggcattgacttgtgaaagagtatagtaccttcaagtgatatggtaaaatcaggaagtagaatttatcttacagagagttttaagaattaattctggaaaggtagccaggggctagactacaaaggatcttgtatggtaactcagccatttcaatttttaaaatattttctatgatgagcctgtcaaaattataagcaaaagaattatatttttgcattttcatagtctgttgcctaaataaaaccttctcattattttgatgtatttccttataatcctactacattaatagattctattttaattattaatacgtaattatccttctaactatagttattatagaaaatatgaaaacagagatgttttgagcagaacacaagagtacacatataattcaaccatttagtgaaaaatgtgaatgtttcaatgtatttccttgaagtattttcctaaatgtatatatacatttccttgatatgtgtcatacacccttactcttgtgctatggacattttctcatgcctttaaatattattcagaaacataattacatagttgtagaacgatattttgctatatgaaaagatttatttacttagagctaattcagtgatgtgtttcaaaagatgggctgaagagttaaaccaaattaggccttgcattaaatttactagcagggtatttaaaggaattcaatctttgtaaaatttaatttcttcatcagtaaaatggagatcaaaagagatctagtatatagggtttttatgaaattcaaataaaatatggaaagcatttcaaaagcctaatgcttagatacaataaccattcaataaataatgttagccactatgatcattaacacgattaacaaatgtcatttatctataataaaacattaacaactgtttgcctatgttttagtgtttataaaacaaccctagcctacacaaagactaataaatggctttttttaaagcatgtaattctcaatggccattatattgattatctgtaatgaagagaactgattcctatttaagtggctttgtctagagaaggtgattttgtactgagtttcttttttctaaagaaggaaaacagttgcattctttagctttgctaataaggtatagacatacatgataatttactatcttactaagagaaaagccattggaagtacaagcaacagggctggcttattcttcataattagtttaagtcccttgagttagccacacctgaactaaagtgcaaagcaaaccaaataaaacagtggggcattctgggccttagaaaaaatgagtgaatttatggtcactaaggcatatgctagaataaaaaccatcatggtgatttttctaagtgacagttaaaagagaatggtaagtacttctcaactcagcctgaagtttagaccatggctttcacataaccatgggttaaatataactgagtctcagtttccctactggaaaatgagactaatgtcacctgcctcagtgggtaaatctaagcattaaatggtttaacatgcaagccactttacagtatttggtacagtgtgggtgctcaagaaatactaagcctctcctgatttcttttattatatttgtatcttaacattgttgactagcactctgaaagcattaagcagtcaatacaaatcacccacacactacatagaatgccgagggaatgcagcttcatttgtcttatttaaaacctcctttgggtattcctcattggggccaattcaatctcctttctaactgctgatcaaatgtgggtgctttcctatctcaatgctcagcctaatcacccacccaccaccctaataataatcatcgcttaagcaaaaattcactgacagttcactatgtgcaatacactatgctaaatgcactcatttaaaccttcctggcctactcttttgtacttttcactacccctccaacataatccatgctctttcctatcaagtacctagggaatctacatctggcctgaaccatttagaatttgggctggtgctggcccaagctgcccttgaccttacagaacaaaatctctgccttacaaactctcatcctttttttgccttaatgctctgttggcagaaacatacatttcttttttctccctatttttgtgagaaagttctgtaatgatagaaagtcatagaattcaaaagctggaagggattctagcttgcatctaattcagtgtttcctaaatgtggctgtgcatcagaatgatctggggctcttgataaaaatagaaattcccagacccaaacccagatagtctaattcggttctttcagcaaacaccatgggttattcttatatacaaccaggttttaaaagcactgattggattcttctttccaccgaaaataaaactgagcaaattcaggcaggaattgtatcttttctccactatatcttccttttctaatactgcatacccaaagcaggaaaacatagttggcacacagtaaatacctgttgaaatgaaaatgaaatcacagtacaccgtcagcattacttatttgtgtgattatgttttctcatccttgttcctaaaaaaggatttgaggcagctgacaaagattcgtgtaaaatctatctctattctactgatcaggaggggaggatttcgttgtagaataatccagggaggtcagcagctctgcctgcttcatagataacttagaaatcagtaacatccaccttattgagaattatatagtttttttttcatgaaaaaatgccatcagggagggatattaaaatatagttgaagaatcatatgtcttgcagtcagataaacctgcatcccaatctgagttttctcacttcccacatgcaccatgccttagcccaaagtctctctgcaggtcgttcctaagaaaagtacttaacttttctttactactatttcttcagctacaagattcaattcaattactctttttcacaaatactaattgagcatctattatagtatgtaacaggtactattttaagcactgacaacaaccactgccctagtaatgcttttatttacaaggcataattatgtctatttcagaggatttttatgaaggcgaaatatacatacaagccttgtatatttgcagtcgttcaataaatgttaattcccttccccatctttcattttcatcaagtgatgtacagaccccaaaatatctttgtgaaaataattctatgtcccttttgaaaatatattctaattctgaagaaaactcagtcagaggttagggtccaaaataggtctttggcctgtatctaggctctgatttttcatgcagtgctagtggaacttacagtctcatttgggatttttcacgttgacttgtcctcaggaagaactagcagtttgcatcttcacagagttgtagatgcagctgtactacagatgaagtcaatatgcatcacaggaaacatgagtccagactaattctgatgagcatgaagctccttcacaagtgtgtttaagggctttatgaagtgactgtaaatgcacttgcaagcagcagaggcaaattcattaccatctaggaaataatcaaactgcaactacatctcaaagaagagattatagggatttggaggactgtccagatttgtaatactatatggttatacatgtaaactataatatatgctttaggtttccatcacttttttaacaatgtctctaccacaataattttcccccatttttaccatgaatgaacacaatgctttcccaaagatggatgtagatgtcacattttgcagctggcctgtctgctgatccctctacccaccacctttatgcatgcctgacatcagggatgcctttactgctcactgagaaaccttcctacccctcccctttcacctaccactgccttaatgggccctaaaaacccagtacatggcctgtatcctttagaaagaaaaccacagcctactgtagcctgttgtgacttccccaccttctaagtttctccaaaagttattctctatgccactttgtcactggttaactgaaacaacaaaacaaaatcctaaagtatatatcaaattagaattgaaagatatgaaagctaaaatctatgttctttgcacagaaaaacatccacctatttgaactcaaaaagattcttgataagttaattatagcccataagattcataaatcttaaaattttacaaagtgtcaatcttgtttctgcatagtccttgaaatatattttgctttcaattgaaagcaattgaaagaaatttgctttcaatttcttcttaatttcatgaagaacaatcaaaattttgggaaattcctagagataattggaatatttttttcttttgtagcattttaatcatttaggcccccaaatgaatttaagtctcctaaaatgtcccttcatcagagagtacctgtatatgctggcagggaccaacagaaacacacgtatttcccactggagaaaaaatgttgtttttctttctatgatttctgcaacatcatattcatgtctgtgacattctaatatttgagtgtacaagaaaacatgcctccaccctgggagagtaaaagaagatgggtaaatattcttcatataacagcatcatttctgtctgtcactatgtagcagatatagagagatctgtttctttgtgtgtccttcctaataataaacaactcgtcagcattagttcagcacctattacatgacatacaatgtattaaagctttataatgaccaaacttgtttcatcttcatagaaacattaagtggtagatataattatccatattttacacatgatggaaatggaggtatggagagacatcaggttatctacccaaagttcttactctatatctgcactgcaccgtaataagccatgaacatccctaggaaacagcaaattttattaattttatttagagaccccttagctaatgcagcacctgacttttaatacgtgattaataaatatttgtttttttaaactaaatgttcactgtgactaagaggcacaatatagcagtatgctttctggtatacaattgcaagctgtgaatattccaaaattttgccataaacctactaatatctacccaaatctagaagggaatagaaggcagttattcctttttgtaaactggagcctacctacacttgtcatagccccaggccttgaccaaacggaagaaacaaacctcactgaatatcaaagataccacataggaaaaagaatgtatatttgtcaaatacagtaaacagaagaataataactttggctttacattattctttatattattcacagcatgttcacagataaaattgcatctgattctaatgtcattgctgagatggtggcaaggcaagttattactctgaattcacatgaagccaaactgacaactattcaatgtttaggaaacaactgtctgactatcaatgacatggcccgtgtctcctgactcctagtctattttctgtgtggttttatgggcatcaaactacgaacagtattcattataagaccattttaaccctaagatgactgagttgcctctactataatttaagaatcctaccttatttccatgcaagtaagatgttaagatgatcaccttggtaatacactttcagactcaatttcacagagaagccccaggctgtcgtcatactttcagtgcaagatgaaataaataaaactccaatgagaccactaaaaacatatgttaaataagacatcatttctctaccaaaccataacaaacaccctagactgcagagaatgttggctctaacatgctcctacaagatatagatcatctctgcttgtaggacatatatgggatgtcctggagacggggctacttcagaaatggtgattcaaatattcaacaaaaataatggacctcagagtaatcatacaatatgttaattttttacaatatattactgaatctcagtaccttgttgaaaaagccaagttatatcttgttatttatagaattagttatacaagacaagagagaaggattttcgacttgcaaggaaagttctcctctgtcctccagtaattacttctataccttctgtcactgtgctttatatactcattcatcaaacactgtctgagaaaaaactcttgtgcgtaatgggttcctgagatgcaaaatgaacgagacataatgcttgccttaaaggaattcacagtgtaggagagtggtcagggagagtgtagattaccattattagacttgctattttgaagtggaatctctttctctctctctctgtctctctctctgagttctcacattggctagttatatgatgtttttggaaaagtctcttaaacttttgttccttattctttgaaatgtcaataatctgagtcaggagaggaagcatttttgtagtgcctactatttgtcagacactgttttacatgttttcaatgtattattgcatttatcctttcaataatcccaatcaaaattactattgttattcatattttatagatgaagaaactgagagatgatatgacttgtttatggttacttagccaacaagtgcttagtacaggccatcaactcaagcaatcagagtggagaagtacctgtcagcatgagaaccatgggtgctagaaggcaaaggattttgaggctagaagcttctctttgccatttgattagacatattcctttagaaagaatgtccctttcatttgttcctccagacccactctccctttttccttgccctggctagtgccttgggagctgacacaagtggatcatggcatcagtaggctcttttgcctttggctgcggtagaattcagtcagtggaaggtaccagcaagaggatagacagaggaaggcaagtgaggtcagaatatttatggctttgttgagtttccttcctgtagggctgtctgtgttcctttcacaaactctgctgtcagagcccttcttcattcaaactttcgtatccctgggtctcttcaaggccattgctccctcccattatccctttgttttaggtctggtaagtaggccccaatggtgcactatcactagtgatttcattgcaccttgctgacacctttataaacagtccctttatttatcttcctcaaatttccctaaattgttttaacctgagtgtcccatctattccctccagggaatgagataaataccagttttataaagcactaaatgatgagcattcctggtcccaactcaccctgtatagtctaatttttctaattcatttttcagcattactgtcacatgagcctttttaaatcctcaaacttggatgcaccttctttttgtagagattttacgtatcctgtttcttctacctgcaatgcaccttctcaatctcactgctcccctcaccccaacaaacacgcatgcatgcacacacacactcaacaaacctacctgccacatataatagatctcaatatttttcaagttaattcgcagaattaaaagccagagactgccttcttcaaatttttcttgaacaatttttatcctttagagtcctattattatggagcagtttatagtagcatattatattttcctaacacatattctgtgggagtggaaagctgagttctgagtaacttaagtgacttgcttaaaaagaaaaacttaattagtaagtgacagtaccatgatttaatcccaggtctgcttgaattcatgcctcttgggctctccctagcgaggcaggcccaggcaacactgttctgcatgctgctcaacaaaggttttctgtcaggccctaaaaatacaaggggcttcaataaaatatttaacggatgtggtggagactatttttttctagacctttctttttctattttgttgtcaatatgttctttctacccactacttttatgaaaccaaacaaagcaacactttctgtggtgaacatgattgcaattttgcaagtgccttatttttgaacagatgaaggaataatggctatcttcaggaaatcttatctgaaacctcttagattgcactgaggcacaataatgagatacattagctcaggtaattcggctcctgggggagtttaatttgaaacaattgaagttgtgaatgcgaatacccagcattttccctctggtttgtggagagagaaccaaaggggccttcaacaggaagctggaagaggcagcttggtaggcagcagagctgtgacttgctttctttccaacttcctcctgccaactccagtggcacagttgtttcctattgagaacagattctgtttgttcagtgcatgtttgtgaagagagagattttcagacactcagatataatggggcattcacacattcaaaactcagctaaatttgcccccagggcacatggagatgatgccagaagcacaagcttgcccggaaatggtgatggaaatacagcctctgttgacttagggtgagtccaggcaaacagcccagccacccagtgccacagattcatgtctagagcatgctggctcctgctctgacccctcaggatgacactgaggtgacctcctctccagagcatttccttgattagttcacttcagagaggtgggttggattttgatttctgataagtctcttcctcattttgctcctcagtgtagttgcctactttcttccatgccagtgacccagtgaaatctatggatattgcaaatcaagtcatcccagatccttgcttaaaggatttcttattcttcagaaaaaagtccagatcccttaccctggctctccatgatctgacctataactcaccttttagcctcatggtccatcccctcattctcccctcatgctgctgctgcacagaatgcttcatgggccctgaacatgatcccttacatggctatgtctttgcacatgccactccctttcttgccaatttcctcctcccttggtccatatcactaagcaactcctcctttggagtgctttttctgagggctactttctcctgccctgccaagagcaccagaagtccagggacttctctccaaaatagtacttaccattttcatctttacaagatggcatcaaatataaggcacatttcacataaatgtgaaaatatgaaaaaaaaatgggctaaccagaactgattaaatatggtattataattttctgtttacttccttctgccattagaccttttgccgacaagtgtttaatcactcacttctgtaacttagttcctaccacaatgtctggttcgtattaggctcttaggaatttttttccaattagcaaaagagatattatgggtgatgaaccaggtggtatctctagagtattcagatatgatccaatatagaattaggaaagcaagtctttactactcctaaaatcttgggagctggatatagaaaaagctaattttcctatataaattttaaataaatttagaaaaagtaaattatttactaaaccctgaatgtttgaggcttagtgtgggaggaacttttacatacattgtctaatgtgattgtcactaaatccctgctgtagatgtggtcttcaatgtttggagatggaaacaatctcagaaaaggaaaatactttgtaagatcaaactacatgttaagtgacagagacacaattcgaaaacaatactcatacctcaaagtctttagtctttatattatgttgctttgcttctttcctattcctctcaatatttcccaaaatgtgagatgtctacaagagatttatgaaaagaaaaagcactaaataccactgaatctcatgctgaaaaaattattccctgtttcattcagccttttagatcaactctagaagacagtctccctttggtgctgggacacatttacttacaaaaatgtgctaaggtatttttgcaataaaaggggagcgaacctgggactcaacatgttggcaagcaggagtatctgcttaatcactcttttcttgtcatcatatttatttttaggctatcttctatttatgataagctaaatggcaattttgctcctacatttatagtagtgacatagtgttttctttaaacatatttaagttttcaaatatggaatataaagaaaactgaggaaaattgtagtgcaggtggttctcaaataaggtaaaatccatgaaggtgataaaagaaagaccataatctggaaaatcagaaatgccttccagtgatggtaacagagtaattataagtttgtaggctacctgatctttctttgatctatcactacttaatgctcttcagtcaataaaagcatatggttttaatgatataatatgagattagttaaaggcgcaaagaattttcaaatcttgtactgctaaatgtcctttctctccaaataatcctaaagaacttatatattagatggaaagtaacacttttcattagctggccacagtcatcccttggtatctacagaggaatggttccaggattcctacagataccaaaatccacagatgctcaagcccctcatataaaatggtgtaccatttgcatataacctacacacatcctcctgtctactttaaattatttctagatgatttaaacctcaaaattatattatctgctggaggccctgtggcatagaaacttgaagtgatgaccaacacactcagccagatgcagagaaaaatatatggacaggtgtcatatatgagagaagtggagtagttatgcataggaagacatctctatctcccctcatgtgggtggaaaagagaagaatgcctttatgtttacagtgacactatccatttatttaattaggatatacttatatagaacctaccaaatcccaggcactgacctaagtatttttagatattaacttaatgcacaaaattctatatgtgatagctactgtaatattttacagataaagaaactgaagcacagttaagtaatccatccaagatcacacagctaatgggaggagtgaaccccatacactcaagtaccaataccacactcttaatcactaagccaggatcaatctgatcatccacaagtgttctcctggagggactcagaaatgagttgtgcagagcgatgcagaatcattccttggagcacttccagcagaaataagacacagaaagaaggttctacttcactgatcctcaaacattgcaatatgtgtacatgtcaatcagcaataaacttaaatataagatcgtcaacttcaagaactttccctcaaaaacaccattcatttgtcattttaactaagtaccacctcctttaacaagatactgattccattcaattactaattcttacactaagctacaagcaaaggtgtagatgttgaggaattataagcattcatatcttggagaatttgtacaatctgactcacaaaataaaaaaatacttaaaggcagaacattttctgtattatttctgggaggatttggtagataaggcattagaaaaatcaccttagaaagcagttttaaaaataaggtgaccatccatccaggttcatacctatcatcacaggaaaattattaatagcaccttccaaaatttcctgggttagatgataaattgtatcgcaatattactaaaagaacatttcatattggggacttcactcttcaatgtggtggaggatagtaatacagagataaaagacatatttgctgccttcaaggatttcacagactggattttactctgctttaagggagatactttaatagaaaattacaatatagtgcaataaatgccagaacacagatgttgaaacaatgtgcctggatagtagagaagaagccctaaatcttgagtgaggaagggtgagggcttagggactgcttccgggaatggtaacacaactggaccttcaaagatcacagatattgatcagtactcgaagatctgatggaagataaacattcaaaatagaaggaaaacaagtgaactttgatgggttatgtaaggcaggtattaacacatactcatcaagaagcacaggatttgggaaaagaatgtcagattttgaatcccaagactatgaaattctagctgtgtgccattgggaagttagtgaatctctgtgagtcttagtttcttcattggtacaatggagaatagtgataatctaacacttagggttgtggtgaggcttcagtaaattaatacatttaagcactctaaaaagtgtgtgatacatagtaagtgctttaatagattggtttaataagtttgatatatgtattgtgaatgtcataagttgagagatggagacagattcttgggtgacatacccaagaagtttgcatttgatcctaagggaaataattattgaaggggagagaaacatagaggagagataagatcagattggattttttaaagattaatcattcttggcaagtgtgtggaagatggaatagagatgagattagcagaaagcagagagaaaagatgttgcagtcgatgatgaatggcagcaaggtaggagaaaaaaaaaacaaacaaaaaaccctgctctactcaggaaacattttatgcagcaccacctaactccatgtcaaaaccttcaccttcaccatgctatagtgcatcctcaccacaaaagctaattaaccaaaataaggtgtggggatgaaatgtgggccttcaaaacagtgatacttctagcatctgtttttaaaagatacatttagaggtgactgaatcctaaagccagaaaatacctaaaggaatggtccagtccagtggttctccagcctggctgccattaaaatctcttggggagatttttcaaaataccaatcctgagtactcacactttgtcaattaagtaagggtccctgggagtgcagctcaagcactgctgagtcttcaagctcgtcaggtgattctaatgtgcttccaggctgaagaacccccattgatctcatccaaccccacactggacagagtagaaagtgagtctcagatattctgcttcttttatgatatgggtaattattgtgttaactgtcttacctataacatatgtagtttcttacacacttgtaacaagattagaacctcttgaacatttgatataaaatcatatgttatgtttatgctgatgctagagatggtgagataaaataagagatgaaaggaaaattacaaaataaaggaaaagaggtagagggagagtttatgcaaccaatatgaagtgagaccatgcattcatttcacagaccaagggaagacaaggctaattatcataggaaaaactagcttccttccagggtgaatggggaaatggtagttaggagagaacagaaaaagtatagagcgaagaagaggaagaaaaaaaaatcctccatgaaagcaaagggctgtgcctaatttgttcattttccatcctcagcaccaaggacagcactttgcaaatagactagtcccatgttttatttaaggtctagatagatggaagaaaggcaggcatggagagggcaaaagggtcaagcagttactcatctgctttttctccttggtccattaaatctggctgaacagtctcagagatgagaaaataatgttcaaaatgtgcagttcctcttatatgctgggcttatttttctggcagaaatggctttgagtttctttggcagaggaattatcagtggttctcatcctaggtttggtgttctatgtagacatgacttttactgatgctctgtgtgtaagagtgtggtctcaatggagagtaagttctggttttaaaatcaggccctgtttcttaccacctaacttggggcaaggtccttcactgcttttagcattagttttcttaaaataggtactgctatggattattgtttctgtttccctcaaattcatatattgacaccctaagccccaatgtgatggtatttggaggtgggcttttggaatatgaagaggattagattatgtagtgaaagtgggaccttataatgagattaatgcccttatagaaagagaaagagacaagacatctcttttcttccatatgcatgcaccacaaaagggccatctgaagatatagtgagaggacagtaaaccaggaagcaggccctcaccaaacactgaagctactagggccttaactgtggactccctagcctccagtactatgagaaattaatgtttgttgttgaaaaaacccagtcgctggtattttggcaaagcagcccaaactgactaagataggtatattccaggtattggaagggttgatgaggttgatgcacatgaatttattaggaccttaccatattgtcagtgcttataaaagttagaccttgtattgtcgtactgcatttattgtattattattttaatgattatagtttgatccttcccacttcacactgatgacagcaaaaagccaggatgtgagaaaccacacaattaggagttggtaggggtagatactgattatcacaagaatatcgtgagggtaaccgcccctatgattcaattacctcccaccgggtccctctcatgacatgtggagattatgagaactacaattcaaggtgagatttggctgaggacacagacccaacccatattgcttgtcatttgcccaaccttttgtttcaaactaaaaacccctaattgaactaggtttggtttgacccatagtcccactgtgatcacagattggggacaaagtgttttaaggtaacatgagatgtctacataccaaccatccctcaggtgtccagtactatcccaatgtgacaagtttctttgcaaaagattgcaattattattctttagagtatagtaaaataaataggaactattgtgattgaaaagagaattattctttctttaaatatttgtcttagtgatcttgattattccatggaggtgtagagggtttacaacatgggacagaaaggggttatctggggagaggacccagcgctttctccaggttacagacatctaccaatgctttagagtttatatacaacaacattttagactggattcttcatttttggattgcccatgttgagaaaatatttgctaattaagtcaaacaagatataatatcccccaatttaaagcatgcttaggtattagtttgctaggctgacctaacagaatatcaccgatcgaatggcttaaacaacataaatttatttttccatagttctgaaggctagaagtctatgatcaagttggttagcagggttagtttcctctgaggcctctcccattgacctacagatggttgacctcaagctgcctactcatgtggctgtccctctgtgcatgctgcccctggtgtatatttctcctcttataatgacatcagttacattggattatgaccacacaaaaacagcctcatttcaacttaatcacctctttatatacttatctccatatatgattacattctaaggtcctggaggttgggcttcaacatatgaattttgggcagtcacatttcagtccataacaccttatcaatgagtcttcaatggatcatatgattgtgatcatatgaaatggtcctaaaatatctttcatattactgtcaactacatgttaccttcccagaaagccaagtaaacaccaaacatttaggagtagctgaatttctttttgggatcacaacaaatataggggttttattggatagtaattttggtgacacctgtgagagctgagagaagcaggactggacagaaagagaagctgcactgtgaggcagttgcaacagagatctttcactgaccatttgaaactcttgagctggataacctttcagggtaggcccagtttgaggtatttattcctttttgtacctctgtattggaagattgctgccatggatggggaatacctcagataaggcagattccttgtatctatctaccacaggctatatggtagatatagttacttcatagtaactagatagtgtgtaaactaaaaatgaaatcctaacccccaaccaacagactgaattaatgcccccttggctaacgggacagtagacaaccttaaaactgaattccctaccataataggaagggaggtcaaatatgactcattttatcccttcctttttggactttagacacaacaactggccagcattaatgttataatagagatcatgagactaacaaaagacactctttttgataataagatatcaaattataaacattacctaactatgccagacaagagttaagtcatgtaaccctacaggtcacgctgacccagtacattggttaacagccttccttgtcttaacctaaacattcctttattctcactccaagtttttagaaaagttttactcctgtaactaattgcaaattaaagaacgcatttatgacctgtaagcccctgcttcaagatgttctacctttttgggccaaaccaatgtaacctccatgtatcgatttatgactttgtctgtaacttctacttccctaaaatgtataagacagaatcatgacctaactgtctgtactagaaatagctgctcaaagattctggttggtttcttttccagggaaaatatacaaagcaagtttggtggaacaaactacaggccccacctctgaaggtgaccttgagtcctcagctgttgctattgttatcctctccggtgcattctaaagttccctcactcttccaagaacccttgactatgcttgtcttgatcgcttatctaattgtgacccagaatgtcatccctgagaggtctgacttcctgatcaccatgtccttcttagtccatgaccactgtacttgtcaattttctgtcaagatatggcaaggaggtaccaaaagacaccccagtgattatactcttccctgtcatggtaaaaactgtgtatctgcagccccactgctctaacaagatggtggtttctttccttgcttgttgacttcttcattcaagaagcctacagtggctgagtggcagctaaatctaaaaggttactgggaaactcactgtgtcccttgctggaagcattccctccttgggaagcaggacctctggagccacagaatccagatttgtagggatgaaaagcacagaaaacccaaatgggacacttggagtgatggttaagtgggaccactcatatatcaattgtcttattgctgcacaaacgtattctgtctcctagggacacagaaacactgtattggttaaagctgtttatttcatcttataaaatggcaccccatccgtgcagggcattgtacctaagccagtatctcagttgtaccttgaagagcctgtcccattgctgtatatgtgtagcagtttctggtaggtgccaaatgtgtaggaccagtgggtcccatctacatgtcaccactgtcacacctccttggctgttctgtgagtccctttgtctagtgcaacattataaaggatgccatggtggtagattactctatgagctgccatagtggttctagctgagaccctgtgaaagggaacagtaaaacttcacatggaaaatattttgatttcagtcaaaataagttatttgccctttcaaagtagaagtacaatgcaggcaacattccaccaaatagctggttggtctccttgagcagttgtgccatactggggacccagctgttgtctctattgcttctaggttgtagttttgaaagtggcagtaactatatcaattctgaagaatgagatcccatgctttcagatccatgtatcacccatagctactctctttttgagcccatcatgctagcaatgggatgcctgataacagaggatagctaatattaaatggttgtttgatacctcctgtgtactagatggtctctgataaaccttaacatgaaatacaaagatcttcataccctggccactcccataggttcacatatataccttttccccagtctttctgggtgatcctgattaccttttatctattttatttgcaggcctttcctaatcaatcagccaagccattcaactctgtccaataattcatacttattcactttgggccacttttcttccctcatgaagtagatattcactaaagttttatccattgggaggatttcctgttaccattatctttcaggactcccctaaggtctatggtatagaatgcctctaactgcacagtgtcatcctcaaatctcttttgctataaacatacacagaacttgctcattcatgaatcaagcttaccttttgtctcctctgacatcgagtcataggagacttctcatgcagccacaggtgttagctctgggagaaatgctgatataacgtatttaaatcaatatttaagtgaatggcattagacctggacactgctcgtgcagcaaattagtgtctactagtcttgctcatgcttgatccacatgtatcacatttacatcttataatgaaattctactgccccctccagagttgtctctatttgaagtaagagggcagcttttatacttgtacatatacccttcattcgaagcaggctgtccccatggaatgggagtgcctagggtaaggcagcttcctagctgctgttagatgaagatgatggagaggcccagacagagactcagctgtgagttttcagcagtcaacactcctggcagccaaaggaatgactgccttggtcctgaagagaaatctttatggcacctcacagcttctactgcacacattttaaaggataataagaaagagataaggcctaggaaatgggagaagtttggaaactctcaaccctgcttgggatctgattccacgatgagtttttcattcatatgcttttttaaaaaaatgctgtagtgaaaagttaggttcaaagcctctgtctctacctacaagtctaagtcactttcacagctgacccatgtaaagaatgtgaatatagaacacattgtcattcccaaatttcttagaggccgtaagtaagaatgacccttagagaataactcggtttttttgttttgttttgttttttgttttgtcggaatgggagactaatgcagaattgttcgttttctaagtctcagttttctccatctgtaccttgaaatagcaatagtccttactcataggttgtaaccacttgtataatctgagaccatatagctagagagcagatggaaagggcatttgatctcaaggaagatggttgtaaattctccactttgttcaatccaccatacattcataatttctacttttacaaatattatgcttaatgaaggagaccattttttcattcattcagtctgttcatatggatgtcttctctgtaccaggagcaatgccaagacctgaaaatttgaccattaagaatacttcccttcactgagcctgcagtctaactggaaagattcacattcatcaaattattaacaaggaaataaaaacatattgccacacaggggactcagctgtggtctctgttacttctaggcagaccctttgatggtggcagtaactagatcaaatctggagaataagattccatgctattgaatccatacgtagccaataactactctcttcttgagcccattgtgctagcaaggtaacaagttctctgaaacagaccatatggtttcatgaatttgtataatagtggaagtcatggaagattttgctaaagtaatatgtgcagcatataagaagcactaagagtgaatttgtagaaaaaatgtttttaagtatttcaggcagaggaaacaatacatgctgagaagccttggtagaagaggacatgacacacataaagaataaaaagaaggttattctagctggaatagagagaccaaacaagagcatggcataaagagaatctgcaggacaagcagggcccgaccatatagggttatgttcaggacttttgtctttaccctgagagaaatgggaaaccactttttattcaggggagttaataatcagatctgcatttttaaaagtttccctagctaccctgtggagaatggattggcagaggacgagtccgaatgacagtaaagaattttgagtctattgctgttttcctgatgaaagatgatgatagcatggattaactgtgctagcagagctggagaaaagcagatggatttgaacagaatttagtcagtaaagttgacagcacttgatactggattacatatgagcaagaagatgtccagtatgactctctgggtttttggttagcacaattgaatggaagtagtgccaagatataaacatgaaagcattctcaggcaaaatgtgattatatatttaaagagttcacttgcatacaaagagaaatctattactttagagcttttgtcagtgctatgatccctgatttttgaattgttcatcctttaggaaattaataaaagttataaaacctctgtctagacaaaagcactttcctagtcacaattgtgcatgtattttgtgggtctgcttcattcaagtaagtttcatatcacatggcatttatgtagtccatggatctgaggctaggaaaccactaaatctttataatgtgtaccttgtggctgcacttgtacattgtagtaaacaaacttggaagataaagaacatgatcttgcattgcttctacaggtatccatttgtagtattttactgttggttaacaaatgagtattgagtgagcacttgcagagcactatcctaatctgtggaaggaattgcaaaacataaatggtcctctgggaacccatacaaaagcgcatcaatcctagtgacagaaccaaacacaagggtcatcatggcactactgtcaggaaaaagtgccgcagagaaaaactgccttctgtcagctgctcttcacatttatggctttgtgtgaccttaggggaaaataaaaaatttccttccccagggaaagagtcatttggatgcagctgcgtttgaaagagaattgctgacttagaatctaattccatgatgaacattttataaaaaatactatatatagcaattatatacactacatactgtatacacatgagacataaattatatgccaaatcagctcttgtgccaatctggaaatattgaaaaaaggatatgtgcttaagttgcagctggtaggcttagaaagaaaaattttttaaaggaaaatcacatacacagagatatagcatcaccttctccaaagattcttttaaaatctcacaatcatttgacacgaaatttagtctttttttggagtttagtgataagttatcaaagatttcttccatttatcttattcaaaggtaataacaccaaattacatgttgagggcttactgcatgccaaatactgtgctagcactttacgtacatcatgtcatttaatctttacaaccattcaatgagataggtaacattataaaacccattctgctaaaaaataaactagagtcagaaatgttacataattttcccagcagggcttcattatataatatcaaatgtcggaatccaggtgtgtctgacttggaaatcccaattattatcttacagatgaccacttcacttaaaccacataccccaccaaggtggacattatgattatttaatgttcaaatcacatgtcattcttaaccacagaagggaggcagggaggcagggaagtgctgggtagagaagggtggggtccctgacaaaggctccacagacctaagtgataacaggcactcctgtttttgtgcccaaatattgcattttccaagaccactctggcctgccatgcccccattctgtgcccataaaacaccggaaaccctagcaggcacagacacaagcagttggacatggagaggagcagaagagaacacccacagacagaaaccagcagacgctggcagaccatcaacagtgaaattcagccaggagcagtgggaggagagccctaccgctgggcaatcggactccaggggaagagtaccttcccactccatcccccttctggcctccccatccatctcactgacagctaataaaactttgtatctatcctccaagcccaagtgtgacccaatttttctggtacactagggcaagaatccaggatacagaaagccttctgtctttgtggtaaggcagagggtctaattgagctgattcacacaagtcgcctgaagagggcaaaactgaaagagcaaactgtaacacatgcccactgaggtttctggcgctgcaaacactcaaccctggacaacgccgatggggtgggagcccataaatgctccacacaacctacccttctgcatgcttcccctagggcttctagcagcagagcatggaagaagcgagccacaccctgtctcacgccctgtgagagggataagggaactacactcccgtttcaataacacaactaccaaaaataggtgttgattccttgaaaactcaattacaaatatcctttcaggaccattgtatttggaaggtatagaaaagccccaggaaatattcaaatataaaagtgaatttaatctaagtcatcttgttagactcatatgaatgtttctttggcaatgggaaagataaaaattacttgggatctagaggacttagtcaaaaaagtcatagttatttcctaaaaatactgacctgaggccattcaaagcagtaagtaatatcacacaaagtagaaatgtacctttgtgtgagaagttctttttagtgaatttcagtattttgccttacaaagcaagtaggacagctccactatataaataatggaagtacatacttggaagatggctgggttaagaaatgatcaagcaatctttttttttcaacatctaagaactgcatattataaaacaaacttatttctacatgttatgtaactatttctagaggttattaaatttcagagacaactccttttggtctgcttctgaaaatatatttgatggaaacgaagagacatgcaagctctttgctattttctttctctctccttgtcagatgtcatacctagagagctgtgaataaaccctctcaattattccatagcttttgacccacatgcataacttatctctcttgcatcagtcattaaattggtacaaggccatgttttatatggttaagttcagagctcatgtgagagtagatgcttcactgaggagtttaaaaatgcttccatttgaagatctcagtttttcatgtagtcatcttcttcaaaaattatctgtgtggtagatgtcctttagcatcctagcatatacatatacaagagaaataatctgtcccgagagtaccatgtaatcaataacctaatgtgatactgcaatcataagcaatcatatctatataataaaagaaaaacacccataacattgctctctaaataaccaagaaagtacattcttaaatcatcttcagttatatggtcatgatagttttatgattgtccaatcatgcatttaaaagcatctgggaccctgaagaattagagatatcattttttggttcagtttaacacttttcaagctcattggcatgctctcgttaaaaaaaaaaaaatagttctctaagaaggatggagctggaaatgaagttatgcctgctgttctttccacctgtattcccctttggtagtcttcatttaaattcataccacatcacttacactttgtcacatccttgcattcacctctacattttgttgtgtgctattcattgtacctgcctatgctgctctctcctgtccccacaatccataccactctcctcctgtactgatataaaatagcaatataggagacctaacggtgtgtaaaaggtacagttcacttcaagaaaaacacaatacacaggaatttgatctcaccaagctgataaattaaaaggaaatagatcatttaataaaacttaaaattccaaaattaatttgtaaaggaagtgtctgattatgcagcatatccccatgctcaattatgctggtggttaaatattattgcaactatttattgagttctatgaaacgggtactattatctccaatttgcagattagaaaaccaggccagagcatttaggtgacttattcagatcaaaaaagagtcaagattaaaccatgtctgttttactacaaaaagagtgttcttaatcatgacatttttctgtctcctcaggacttgcttacaaatttcacatttatctattacccagcctgagatgtccttccttccctctcaccattaagatcctatcacgcattaggaatgtatttttcccacacctaacatttcattccttagaaggagatcaattagtgtggctctaggcttttctcagaggaggaggagtgacttattttgtaagtttcagaagagtaactaggctcagctcatctttaccttatttccttagggactgaaaattcttttagagaaagagctatcctggggttctaaggcttacatgggcagcccatccatatggagaggtgagcccagtctcctagtaccgtgatcggtgggtaagtctgcctattttcaggggtcagtttcagcaaacccatttgacattagactaagctcccagcctagtgtcatcggtatttatggtgaatactttttttcctccatcttttgtttctcaacattttcagaatcagacaggaatgagggagactgtttgagaggctgcccaaaatcccaggttctgcttcctcgaaaggcttttcccaggcccccagtcagaaatcacctttccctttcctatctcctcactactttgtatttccatactagcctttatacatgttcatttatattagtggaaaattgtacaactctgtatgaaactgtagaagctcagaactatttctctcacccatttataagtgcttctcccatagtacctaacatagtgttttgtagatagtaggacctcaaaaacacatgtgtttaattgaattgaattgaattgaattgaattgaattgtttctgtgctatgtaatcttcgtgtatagctttaaactttttttttccatttatattttccttaattctgcagtctgttaagaaccataggagatacaaactccattttctcctctctgcagtagaccactcagtgcagtgattcaggcacagtggagaagctataaaattgccagccttctgactgacagtgagccagttaactgttcccattaggagaattgcctgtttgtttctcctcacgttgactatgattacccaccctgtgcaggcctccaggatggaggcatggagggtggccctgaaattaagagaaggaacttcgagtctcagaagtggcaatacccccatgtttgaagctgtgacatcttcaggagtagctgggagccagctgccattaagtctattttaggcatgaggaaacctagcatttttaacagaaaatggagtcttgttgcatatcttacagttttattccaaatgactatgaacatgacagtttttctgaagcaatgaatttaacacctagcattttaagagcttgagcttattgctgaagcactaattaagctttacagatgagagactaagtgactcactagaggtgacagagaacatcagtgatgggactttcggatgtcataagggcctgtgggggggttggaattgttcattcagcattcgtctttatttgaagctattctgtagctaataataacctagttcattcatttactcactcattcatccattaatgcatctatgccttaaaacattcaataagcttttattgggcacttactctgtataaaatccaataggaattgctaaagacagatataggcaaatcattgtttctgcctttaaggagcccacaatgaatgacagatcagaaaatgaattagtatagtacctagtgataaagtctataataaggtaagggagctaagaaaggataaaagagaggttctaactatcctgggtctagaacaatctcataaaggatatgaggtttgagctgaacattgagactttagcaggcattaacaagaaacaaaagaaaatggtgtgcagcttccagtgtttctggggcagaatatttctctggagagaggtatagcagattaggagaactgagcaccagctaaggccagattttgaagcccataggccatgctaagcaagtatttcggactttcctgttgctcacagggagctgcttcaaaggggaggatcatgttataaaatttacattataaaaagtttattgtagaaccagattgtcgattgttgtcgtattccttgtctaataggaaaagactcctgtttaagagatttttatgatagaataacagaacagaatcctgattaaatgcctggttttggggcgtgtaagtcatagaaaagagacaagtgggaactcaggataaaccctaaaattccagcttaaatacatgagtggatgcacatctatcacagtgttagaaaatacaaaatgaaagtagatgttgagattgaagtctgtaaaatacccagatggcagagagcagacatagcaaagagaaggtgagaagtatgatcaggaggtataaaacagtcaatgataaagagatattggttaaaactatggatgtaggtgaaatctttgctatatccaaccgtatttctaattgctttggctgcatagtgatttgtacttttaataagaaggtcactttaagtttattctacatggctaaagtaactattattttttgaaacaccacacaccaaaattttgacacatttatacattattctcacaaatatgggaaaatgactacatggataaatacaataattaaattatgtaaaaatgtgaccctttctccagtgatcaagaaaaaaataaaactatggttatggtagaaaaagtgtttgatttaagcctctatttaactttattagaaatatactatcctttcctacaccaccttttgtgctgctctcctcatccagccctcttcccagcccatcattctctgcaatttgaagggcttaacgttagtttccaccctctcttcaagtgtcagtggaaacttatttacagaagaccttaaaggcagggagcctctttgtgctttacaaacttcacatatcagactaaaaaattgatccataggctggttttaaattgcttcttgtccaaactctacctatttaggttccatctaaagagctaaacaaaaccactgagcagaaagatgaataaagaggtgaagtcgaaattgaatgtggattccacaattatagaatttccttttaattctcagtgcaggttgtacctctggccaagaaaccttgtatggccccctcttactgccaacccaacctgatttataataaaagagcacttttcacaccacatcagaacagcttttatctgtctgtgactgaagtgacaaatcctcgaggggagggaccttgtcattcatttgaggcatctccacacctagtgtgacatcaaatccaaaataggcactctcagcagttttcagaatttagttatttacctatcaatgccaaattatgatgatccttaggaattaggaaatttttaaaaataaattgtaattaattcatttcagaactcatttttttttaaaaaataaagcagcatgaataaaaatatcactggggagttgtgcataataacctattttaatgaatgaatctatttcatgatattacctttttgttcaaggtttataatatgccttcccataatgatggagtttcttttctcccaaaaagcaaatggatttctgttcaaaaacaaaatgtggacaattaagttagaatcaaatatctgaaattcagggtaaagcaagtttctcatattgtaaaaccattactgtaataaaaaaagttgatttaatcataaagcagaaaataataaaactgtgatgcctctgttatatatgctcagttgtattcttatgtatctgagtttaaaaaaatttactaccagataagaatcatctctgtgttatagacattttcatagatttttatcagcgcctcccttgctgtgttatgtatttggttttatgttatttacccagttggagaacaagctcctaaaggacagtttattttgattccccagtacctatgacaatgtctggcataaggaaggaactttaaatatatctcttcaataaaggacaaaacaaaaaaaaaatgttcttttaattttggaataaagagatcaggcctgtttatacccccctggcttagtcttagatagtgtctgctggttattcgtatcgctatgctccacagccaagcctctgacttcttggcaagaacagtgcacaggtaggaagtcagtgaaggtcatgaactgacgtcagacaccagaaggcataggcgtgaccttaaagctgagcaggtagaagaaaaacagagctggggatcagaaagtgatctgctaaagctgaatccggatgaaagggaaaacaacagtgtcttagggactgtctaagatcagcatctaaagaagttgatgagtgacaaattaagaaaattagccagtttatctgcagtatacaagttcttcacaccaaaaccacacgagcccagaataagccatgctttcttagtatttatactgttcctttcacctataacttactttcatcacttcagttcttctgccatttttgtatggcttatacatctcagttattctctaagaagtcttcacacctcaaaactacactgggaacactttctataaggtcatattgttctttgtgctgccaaacccatcatagtgtctggaaatagttcattcagggatgtgttttactaatttttctgaaagttgaacttattcccagtagctagagcttaacacagtgcctaatacagagcaggcatttggtaaatatttgttgaatgaaataaggaggcatgttttgtttttacaaatgggaaggaaactactgaaacattgagtagcctatttagtatcacagttagcagtatctagtatttatttattcaacaaatatttatcaagttcccaggtactgtactagattctgtgagcattacgttattaattttttaatcttacaatgacccctttcatttcgtgtccgttttatatgggtgcttttagtattttaacattaatgataacaataaatatgtagatttggttcttttgtctcacatgttgcagctaatgaaagcatgtctcatggaggttaactaactgttccaggtctaatcgcctaacaagatgaggtgctagaatcaaacccaggtctctctgatccaaagacaattatttccctactatgcaactatgaatatatataattaatataattttctaattttgtgagcaaataaaagagagattccgttcatctttgatgtctttgacaatagtgaataaataattggatgattttgtttcctttggaacttgtctatataactaaacaaaattctcaggactagtaaaaaaatttctagccagatctctctatgtaccttaattacttttcattaggctatatttaattaagaaagcaaataggccttattaaaatttaagagttccaacttttagtcaatattttatggatgctattgagctttgtactgaaatccacagtatatttttctcagttcttatctgggcttcatagggccaaagcatcagaaaattagttttcttattgtccatttgcacttattatagttgtaaatatcctctgataccccaatagtgggaataaaatgatttaatattaagtacaattaaggaaaattgaaagagattatgtaataactagttgttaaaatgtaaactatattttatccactatttagtgcctgcaggacatctatttaaactgattctgagtttaaatatttagtatttacatccagtactgagggaagatctttatagagcttcacttttacaggactataatcacacttgtcactgctctcctcactttgtccaagacctttccaaagtgcccaagcttcttgacctcttaatgtaaatggatatttatatgcaaaacctgtgaatgtgtgtatgtgaatacatgtagtgaaggaaagcaaaagattaaaaattaaatcaaggttaaaattaaatatttgggacttcagaaaaagctgtgttagggcggaaggaagattgcaattgtaacagagttctaaatttgattctcagtactatcactatctcataatcttaattaaaatgtctgaagagtcttgacccttacttttctcatatagagtttagtaacactaataaatagttaactagcaggagaactcagatgagttaattaaataatgttgctgacagaggttttgtaaatataaagcaccatacgggggtatatatagtattgaaaattaccatttttcctagtgaaactatatagaaataggtttagatgcagagcacgtataattcattttcctccatcaggtaggcacatgtggagaatatatatatatatattatatataatatatatatatataatatatataatatatatataatatatataatatatatataatatatatattatatatatataatatatatataatatatatataatatatatgtgtgtgtgtgtgtgtgtgtatatatgtatgtgtgtgtgtgtgtgtgtgtgtgtgtgtgtattttttgtttgtttgtttgtttttgagaccaagtctcgctctgttgcccaggctggagtgcagtgaagcgatctcggctcactgcaagctccgcctcccgggttcatgccattctcctgcctcagcctcctgagtagctgggactacaggcaccagccaccatgcccggctaattttttgtattttttttagtagagacagggtttcaccatgttaaccaggatggtctctgtctcctgacttcatgatcctcctgcctcagcctctcaaagtgctgggattacaggcgcgagccgctgctcctggccagaatatattttttatgatgaacttctgaatgattttcctactgtcagagaatgtgaatctagagttgtaccagagcctaatttagatggtggggtaggatgaaggaaggctttggggaggaaatagccaaatgaataaatataggccagatgaaatgctgggagtagtcagggcttgggaaaggaaataacatttctagtcagcccgaatggaactctcagatgtgactgttctctgtgggtttagtagaggagatagataaatcttaaaactgtaataggaggcaaaatctggtcagtgccatgagagtctgtattagtccgttttcatgctgctgataaagacaaacccgagactgggaagaaaaggaggttccacatgactggggaggcctcagaatcacggcaggaggtgaaaggcacttcttacatggcagccacaagagaaaatgaggaagatgcaaaagcggaaacccctcataaaaccatcagattttgtgagacttattcactaccgtaaggacagtatgggggaatggtcccccttgattcaaattatctcccactagttccctcccacaacacatgggaattatgggagtacaattcaagatgagatttgggtggagacacagagccaaaccatatcattctgcccctggcccctccaaatcttatgccttcacatttcaaaaccaagcgtgtcttccctcagtcccctaaagtcttaattcatttaagcattaacccgaaagtccacagttcaaagcctcatctgagataaggcaagtcccttccacctatgagcctgtaaaatcaaaatcaagctaattatttcctggttccaatttgggtacatgtattgggtaaatacagccattccaaatgggagaaattgtccaaaacaaagtggttacagggccgatgcaactccaaaatccagcagggcagtcaaattttaaaggttcaaaatgatctcctttgactccaggtctcacatccaggtcacactgatgcaagaagtggactcccatggtcttaggcagctccacccctgttgctttgcagggtacagcctccctcctggctgctttcagcgggtagtgttgagtgtctgaagctttttcagggagacgatgcaagctgtcggtggatctaccattctggggtctggaggacagtcgacctcttctcacatctccactaggtggtgccccagtcaggattctgtgtgggggctccaaccccaaatttctcttctgcactgtcctagcagaggttctccatgagcaccccaatcctgcagcaaacttctgcctgggcatccaggcatttctatacatcttctgaaatctaaacagaggtttccaaaccccaattcttgacttctgtccacctgcagtctcaacaccacatggaagctgccaagacttgggggtcgcaccctctgaagccacagcccaagctataccttggccacttttagtcatggctgtagtggctgggatgcaggacaccaagtcgttagcctgcacacagcactgggaccctgggccaggcccaggaaactactttttcctaggcctcctgggcctgtgatgggagggcctgccatgaagatctctgacatgccttggagacattttccccattgtcttggggattaacatttggctccttgttacttatgcaaatttctgcagctggcttgaatttctctttagaaaatgggtttttcttttctatcacattgtcaggctgcaaatttcctgaacctttacactctgcttcccttataaaactgaatgcttttaacagcacccaagtcaccttttgaatgctttgctgcttagaaatttcttctgccagataccctaaatcatctctctcaatttcaaagttccacaaatctctagggcaggagcaaaatgctgccagtctctttgctaaaacataacaagagtcacctttgcttcagttcccaacaagttcctcatctccatctgagaacccctcagcctggaccttatttgtctatatcgctatcaggcttttggtcaaagccattcagcaagtctctaggaagttccaaactttcctacatattcttgtcttcttctgagccctccaaactgttcgaacttttgcctgttacccagttccaaagctgcttccacatgttcaggtatcttttcagtaacatcccactcttggtaccaatttattataattagtctgttttcatgctgctaataaagacatacccgaaactgggaagaaaaagagttttaattggacttacagttccatgtggctggcgaggcctcagaatcatgacaggaggcaaaaggcacttcttacatggcagccacaagaaaaaaatgaggcagatacaaaagcagaaacccttgataaaaccatcagatcttgtgagacttattcactaccactagaacagtatcgggggaactgccccatgattcaaattatctcccaccaggtctctcccacaacatgtgggaattatgggagtacaatttgggtggggacacagagccaaactatattggagtctacgcctctaaaccttgcttcagcaccagacacttccacctcagttatgtttctaccatgccttcttcaagccaaaaaccttaagctcaccctttgctcctctctatttaaaactccgcacatccaatccaacagcaaattacattgtgtttaccttcaaaatatatcgctaacatttgcacttctcaattccaagctatcttcatcccttacctggattagcatattagattcctaattgatcctctaatttcattttagatcctctctagtacattttccacagagtacctggaataatctttaagcgtagattaatcatataattcccctgcttaaaacattccaatggtttcatatcatatttagaataaaatgatttacaaatcaaatgtgatcgtgttcctctctacctattcaaagtaatctcttactagtctccctttggcacattatgctccagccccaatgttcttccttctattcttagaacataccactgcttatttctgcaccaaagcctcttcattcattgtgtcttcttcccaggacattgttttcatagacctccatgtgactcttctaatttttttggtcttagttcaaatgccgccatctcagaatgcaatttccttaccagtctagctgcagtgccacaatcccctccagcattattatctactccatcgcattttactgttttatttcagcatgtattgctatctaaatatattatctatctatgagtatgtgtgtatttgttttttctgctaaattctctaacaaaagccccataaaagtaaacacccttcttatctcttatcatatattgccagtacctggacatgtgcttgacacatattagcacttatcaaatatttttagctgttaaattattttttcctatataataaatttacatttacctaaagtagatgttgaatttcacacaagagcagaaagagttacttttaaactaccaactataaattaatttatatggtaaactaatttccaaataaggcttttcaaaatattctgagggaatattagtgagttttgaagacaatgagaactgacagattcatctgaaagttccatgcatagcttatcacattatacccagaaaatcattaacatgctttagcctagcagaaggaaaatcaatttataaataaaatcaacaggtgcaatataaaatgctaaagtaatagaatgtgactatgtgcatagtttacatgatgtaccactaggcagtgttttcgctggtgacagcatagtgggaatgactttttggagaaggaatagagtgcaaaccaagtaatcaggaaacatcagggattcacaaacacccataccccatgggggcattgacaataccattaatgaaccacagtgtgaaattaatgcactgccttgtggggacaatgatcccctgagacctgcctgtggtggcattgtagctatgactcattgtcagcaactattagaaggaaaagtgcctggaaaaataggatagaaattttattaataacataatgctgatataagctgggagggaagtatcttgttttctgttatgagttaagaaattaactacttaaagttgtaatgaaattgatgtaaaatgtttaatatgaaatggttgcctaacatgtcagctgattacttaaaaaaaaaaaaactattccgtttaaacaccagtaagctattgagcacctataatgagccagacattgtgggaaatacaaagaaaaaaagaaagaatgaaggtgaagagaaagggaagaagtgagaaaggagggaaaaagtccatatttctttaattcatagagatcagaaattagctgtagcatgcacaggtaaacacctaatatatcctgtcttactatgattagagagaactgcattaacagaaatataaacaaagcatcataggcagatatatgaaaaataaattcattattgagagaagggaggattgggtaactgtcaaaaagtaattaatgccagaatatatccttgaaggaaagcaagatttaaacagaaaaaaaaaaatgtttcagttgctgagtaactgatattctggtgatagttgtcatatagctaagtagataggtatctcactgtcctgtgtattactgatacacatggttatattcaacaacataacctgattatagccattgtttgcttttttctggtttgaattgtaagctcagcacttaaaatcattattccccaaggctaggtaattgctaaatgtttatattctattcacaagaaagttgcatgatgctgctttacatctcacaggccctgcctccttagttcagccaccttcctggtgtcctaaataggcatatactgatacatagagagtagatgagtctggagctcaagcagagaggtctggcctggatacaataaatttcagaatcaatatcaatagagatgattgtcaaatccatagggaaataagttatctattggaggccctgactctcagttacttaaaatcagtttattggatttaaatcaaacagtaaccataatttttaaattgtactacaagtattggtaatcttgctatcctaggtgaacagtatatttttcatagctaaatgtgtggtagtatagtcggtggctacagtttggatcatttaatgagtaggacaaggaataaccatgaaaatggttttccactttcacaaaaagaaaagagtatacaacatgaataacaaaaagagggctgggcacagtgactcacgcctgtaatgtcagcactttgggaggctgaggtgggtggatcataaggtcaggagatcaagaccagcatggccaacatggtgaaaccacgtctctactaaaaatacaaaaattaaccagatgtggtgatgggcacctgtaatcccagctacttgggaggctgaggtaggagaatcgtttgaacccaggaggggaggttgcagtgagccaagatcacaccactgcactccagactgggtgacagagcgagactccatctcaaaaaaaaaaaaaaaaaaaaaaaaaaaaaaaaaaaaaaaaaaggaagaactcaacctcttgagtttataaacagtaggggaaatatgatccagaaatgaaaaggaaaaataagaattcagaagagtagttccaaaacaaatagcactgggatacaaaagctaagagaagaaggaatttcaaaaagaaagggttcaagagaaatcaaagagcaaaaagtaaattgcaaaaaagaatgttagcatttaacaaagcaattttgtaggaagttttgaagagaagatgactttcagaaggcaaggaattaataaaggaatggaagtataaaatgtgctccattaatacaagtttgaaagtaaacagaaagagagaaatataactcaggaggggatgagagcaaattaagacttctttttaaaaaaagattttgagaattgtgtaaatttgaatgtcctggaaagggtgaaatggtgaaattcaatgagaaaaattgaaatactgacaagagttctgagaccaagtccatacatgtgtcttgaagggaaaaatctgaggtgtagagacaatgaagacattgactctgagacatagaatgagtcatgaggatatcttacaaaaaccacagaatattgcatacttcctactgtaattgtctctcatctgtacttctcagctatctttctcacatagtatttgacgctgtgatgaattacagggtggatctcatattgttactcctccttctccatattccttatgtaattctttcagagggctttttagaccatcaggaaagccctagaaggaaaacaataagggtgatgtaatagaaggtgggatgtagacatgatgaaaaatcaaggtgtgaaatattagtttgatgttggttccaagtctttgctattgtgaatagtgccacaataacatacgtgtgcctgtgtctttatagcagcatgatttataatcctttgggtatatacccagtaatgggatggctgggtcaaatggtatttctagttctagatccctgagggatcgccacactgtcttccacaatggttgaactagtttacagtcccaacaacagtgtaaaagtgttcctatttctccacaaaatgtccaacaatgatagactggattaagaaaatgtggcgcatatacaccatggaatactatgcagccataaaaaatgatgagttcatgtcctttgtagggacatggatgaagctggaaaccatcattctcagcaaactattgcaaggacaaaaaaccaaacaccacgtgttctcactcataggtgggaattgaacaatgataacacttggacacaggaaggggaacatcacacaccagggcctgttgtggggtggggggagtggggagggatagcattaggagatatacctaatgtaaatgtcgagtaagttattgggtgcagcacacctacatggcacatgtattcatgtgtaacaaacctgcatgttatgcacatgtaccctagaacttaaagtataaacaaaaatttaaaaaattagtttgatgttgagaatgtcacagaattaacccccatagattaccagcacaacagcagagaatagactacatttggtgtaagagaattagtggtttaataattgaagttgtttcaactctcaggcgtttttgtcttatttgtttttattaaacagattaagaagatgaagaatgaggaaggtgaaactaaggtttaagagaaagtgtattcataaatagaatggtgccttatttaaaatcgatttgttgagcatgtggtaaagcttttgtcttactgaattaatataaatcaagtatggtgaagctaagtgacagcaacagagatattgctgagaataatgacacatgctgttcaactattcaccttccagaattgccaaattcaatctagcttcctctcagcttctaaattaaagggactcataaaagtataaaagtatttgagccccaggatattatcatatgtgaagctaactttgagtcaactttctagtaatacaaggcaataaaatccaaatagactgatagatagataatagatgatagagggatagatagattgaatatacatactatatatatactgcaaccaaaagaggcttgactcatcattctcagattcatattttcaatgtaaaatatttgaaattctaaagtagtatatgtaatgtttctacttgaatatcaagtcactatacttaaaataaatctcataatcttgttcccaaagctagttattctctgtgttctttttcttaatggttgtttaagcaagaaatttagaagtcatataaccttctgaaaattccatagctccattcctcagtatttcttaaatgtcctcactctttcccatctccattgccatgatccaaactgcagtgtcctctctcctgaatcagtgcaactgaaacttaatttgcaattgcatcttccacttttgcctctgttctgtaatttttcatattgtaacatatatagaaagttgtttctaaaatataaatctgatcctctcattgcctatttacatttcatgtattttcattgaacttcggatgaaaactaaactctttaaaatggcctgtgatttccatatgatgtggagtttgtcttttgccactatcctcctcattcactgtactggccttctttcactttttttttttaaatgagtcaagcttctttttaccacagagcttcaaatgggatactttttcttcctgggatattgatttacctggctaataaatactggcatatttcttcacctagttaattaccactcatctttggatctgagattaaatgttcactattcatggaattctttctagcctcagagtagataaaatcagtttcttcattatatttctttccattgtggtcatcaatttgtaatgaaaaaatatcatttaaatttggtattagcatttttctcaactcttatggcatcaaagctatattcagtgggtattttgtacctgagttcaatgactggcatacaggatatgctaaataaatgcagttgaagagatgaaagaataaatgagaaaattatggaggagaaagtatgagctaattgctaacctatgttgaaaggttgaaaatgagtactgatggtgagcagatgaaagaagtaattatgtagatggtgtggtccagataatggacaaataaggtgaagttcaagatggactagagcagttgaaaatgcaacatggctggggaccatggctcacatccataataccagtgcttcgggaggccaaggcaagaggattacttgagcccaggagttcaagacgagcctggctaacatagaaagaccccatcattacaaaaaaattaacaattagctgaacatggtggcacacctctgaaggtctagctactctggggactgcaatgggagaatcacttaaggccagcagtttgaggctgcagagagctatgattatgctactgtactccagccggggagacagagtaagacactgtctctaaaaaaaaaaaaaattcagaaattaaaaatgaataaaaatgcatcacgtttgtaatcttaattccactttatatattgtgattttaatttaagtcaattttcaatactatctattaatttcaacatttttaaatgtgtagagcccaactgttggtaactaattatctgaatatagtaacagcattccatgtattgtggtaatatgcattatcaagctaaaatcttgccaatttctaatattcaataagatgtctctttcttataattaaatgtttaatgtagcaaatcaaatggaaagatgcagcctaatgattaatgagaaattgataatcacatctcaatttaacacctccttataacatttaatatttttgtcattgatgtaaataatggaaaattcattgtagattggtttcagcattaaagaggatttattagcttatgtaattaaaaagttcaaagtggtcaggcttaaggtatagggtgatcaggattctggctccatttctttgtaattctccatgtttcaacttcattcttgggctaatttctcttgtagaagaatcactgtagcaatcaccagccttacaacctcatatgctattgtccagtgagagaaagagaatatctgtgtcccacaattcccaggaaatgttctgagtaggctaagagaaatctaagtgctaaacagcttgactaaggttacctaaactaataactaaagcaaagagaagaattactctggttgacagagacaagtctggaccctctagagttaaaatatgaatttactacaggagaggacaggagtgaatattggaagaaaaacattacccattatattaaaagtcagggcttctagataatgctgtaaatgtacaactgaataaaagttattacatgttgtatatatatcttctagtcacataaatgaatatagtaaaattaactttactggacattaacataaatacaaatatgaaattataggtggcccatcaaagaagtgtagagttcttaattaatttaccatacaacctttcatcctattactctaaccatacttccacagttttcaagtactttttcaagcacttaggtaatcagaagagattatatttttatttctcatataattagctgttctacaaattcagatgaattaccgagttatttcaacaaaatgactttttcttgtccccatttgagcacaagcattaaatgcaatgccttgcacgcagtaagtgctacataaaaatgtgttaattaaatgaattaacttcaagttttgaagatgcattaacttatcaacactataattttcactttaaaagtattttcattatatagcatctagaaaacaatggagtatttgaattgagggattcatggtgtctcatacacttattcattccaaaatttatcaacacaattgaaaatctctctgaaatatattgtgctaggcagtaagtaattattcttcattttatagtttctatagcatcttgtgcatatttaaatcattgtatttataatgtttaaattgtcattcattaatttaataaataattattcaatgtttactatttgccaagcactggaatataaatatattcaatatacaattcctgcccccaaggaacttcaagtgtgtatggggtggtggtggaggtagaggtgaataaagaacagcttgtcattgtatctcaaatgatagcataggcatataataggtgcctaataaatatttgttacctttacaaataatgcatgtgaaactgaataaataatgtcctttgaagaactttacaactcactcagtttctctggaagtgctgagagtggggctccaatcaatcatggttaaaaaatcaatcaagcaggggaataaaacactgaattataaactgaattgtttgagagtgttataataaaatgcaagacattaaattatctttatagaatgatggtaacttccctaaaggataaaatactttgactttcctaatgatcccccttgctgagttctttattataactagccttagggtttttatccaagagttcatggaaccagagctgcagttcccagcattggatgtttatcactctacaaatactatgattctcttacgtgtgagaatgcttagactctcaatatggccatctgttatttctgtacttccatattcaatcctgtgtttaactttctacatggccacattggactcccaattcttgcttgttgctgattatacaaacatttacagaatgcctattacacgtctttgactctgtgagaaacatgggacaacgagtccaaggttttgggttaggatgacgtgacggaagtccaaacagagtaactaactggggagaaaactcagtttaagtcttgtcttttctttaaagcttactctcactacttttattcctgtaaataaccttacagttcaactcctctgaatgcgtacattataataactgccatttgcttatatatagcttcgggttgttctaagttgttttctatatcaaaattttgttaaccaaaatactctaattttcttgaagacataaatactctaattttcttgcagacaggctcatatcttccttgagcctaaacctcagcataacctccaaagatccttactcatttaaattgccgacatatctttctctttcttcttataatagtctttcttctctaacaattgcctcactccgtccatttactcaatattaaagacaccttctttattgacaagcaatgaatccagtgaagtgctaggacaatggaatgaaatagtgtcttgaaaaagagaagcacataacaattaaaattacaatgtcattcacgctaaggcagaattaagcacacagtgtttaaagtacaaaactgctctttcccacatgtaggatcacagaagacttagaataaaaggcatctgaaatggggttagaaaaacagccagaatataggaaaatgaaaacaaaaagcactggactaagtgaacatgaagtgaacattggtaccatagtagggatgattaataaaaaatgtgatatcttgcaggcacctacagtaatgtggcatacagaaagaaaaggggaatgaaaagaaagactactgagaaattacaggataaaggatcttacgtgcctcctcaaggagtttggactttatttaaagacaaagagagccaaatttaaatgtttaagcagagatgtaatattattacatttgtgttttagaaatctcactcataacagcaaagggagaacagtagcacctaattcaagtgagagataataaggttcaaaataaagccatcactgagacagtcaagggaaaaaaatagcttcccaagacactgagtcaatggaatcatcgtgactttgtctctggaaggagcagattcctggtgagaaagagtgacactgccccaaacctataatccttgtttgaacaattagaggaacaatggtagcattcctttagagatatatggcagaaagggcaataatttctactggtgaaatgaacagtactgatattttaggccagttttattggaggttcctctggagcaagctgtctagtaggtgttgaatattttaatctagagcacaggaagaataacaaggctaaagatagatatgtagaagtaattagatataaatggtaattggagtcataggataaaatccaaaagggaaactatacaaaagtgcaatagaaaaatttcaaagacaaatctctaggaaatatctaaactcggcctgtaggatgagagactcacctagaggatagagaggaagaaaacagggtggcaagaggagtgttaggagaatttgttactatagaagccatgggatgagattttccaggagaaagtagtcaaccatctcaaatgcagcaaaggtcagtgactcccaacactccctctcacacctaaatacaaccctgaatgattcttcactttactctgacactgacatttcttagatccagcatacaaatgagatgtgttgattcttccctcgtacttgtttgaatcctctcagtgcttctctctatataggtctaagcttcaccctcacatctgcttgttccaaacacaacctacaacagaaatgcttggtaattatactctagagtatgtttgtttttttttttcaaaatagtgtcacatcccctgatctgaaattacagatactgaactatgaaccatttggcactgcctgtttctctacgcttctcttgtagcctgggttcatgttttctactcaatacatctccctaaacagatttttatctctttctgtctgagatatgacttatgctctaactggacattcaagtatgaacagccagtacagttaaaccatttgggggcaatacaaactagaaaagaaattttgtcagactaaaaaattataataaatgaatttctcaattgctcgtaacatgcagcatcctcattgggtgatcacattccctttaccagttctaccaaatatagatttattgataatatctgaattaaatatctcaggccagacttctctacatttcagattatatgtgtaactgcatttgtgacattcacttgattgtttcacaagcgtttcaaagttaacatgtttaaaactaaacttccccaagaaacgtatttctctttagtaaatgttactaatcactcaaatcagaaaattcggtgtcattctagatttgttttccttcctcatactccatagaatattagtcacaaaaccctgcctctttgtcctcataaacacagtatttcttacttcagttccttattttccatcctataatcacttccttgtttcaaatcatcacttctcacctgacttatggaaatggcctcctaataagtacttgaaaatggaaaacgtttaaatccattcgcaaagaagagtcatctataaaatagtataaattagactgtgtcatgttcacattttaaatttctgtgaaaattaagtggctggaattttccttacataaaaaaatgtggattcatgcctctttgcctttgttcatgatatttgcagtgctgcaaatgccatctccatttttatatctgacaattttgcaaaaacttcaagactcgatacagtaacttctctgtcttgattaccactgtaccctcagcatataataaactgcttcacatacaacaggcacttaatatgtatttgctgattgatttattctgtctcaatcatgtccattttactttttagtacctttcagtttttccagttattagcaatgtctttttataacattattgctgtaattattatgtattatataaatatggcctagaattttatattttactttgaacatttgtttcctggaccatagtgtttgctcctatcacatttgagtaaaaatatttctgctgtattcagcaagagagttttctcaaaattatccttacttttgtacatttcaccaattgtcagctctttgacactttagatttgagaccagatatcaacttataaaaaataaaataacttttcttcaagacatgggcccaatttctcgtgtctcattttgtataggtctttgttatacatattattcaattgtatttaaattatacttttctgtagtctttccttcttcaagtctttctttcttcaagtcttccaccagagtataagcttgatttaggacagatataatatgtttgtcatcaaatttgacttaggcttggaacatagtagatacttaataaatgttgatgtacttggactgtactgaatttggtccactattttcagattccaaaaggattttctaagaattacaaatttcaatttttaagcctaaatatggataatataacttaatgttagctataatcggttttatcattatatcactggatttttgaaaaagtgatggccaaggactccaagacagtcttaaagatgcctgagcatttgaagactcctaagaatgaaatgaattaatgatgaatctcctttaagcagaatttgctgctgaaattttacaagtcagcattataaatttcttgactaatcagaaattaaattttaagtttcctgtttaaataaaaatattttaacgcattataatgtacaaccaaaagagcacagaaaccatgatgtgtagtacattgaatttgcatgaaattaacaagcccatttaaacaccaatcagatccagaaataaaactttaccagtgctccagtgagcaaggtcccaacgttccagcttgctcattccaagtctaacacactcttcaaaaggaaccaatgttttaacttccaatattctgggttattgccttcttcaaaattttatgtaagtggaatatgtataatcttctcctttccgtatattttctttaacttggtattatgtttattatattattcattttccttcatgtaacggtagtttgttcattttcattgctgtctactactgtattatataaataaactgcaattcattatcctttctactggtgatgaacattttggttgttattaaaatgagactatttcaaatagtgctactgtgaatgtaagagttgaaaaaagaggaaacaaacactaaatgcagctggcagttaaagacaggtttactttagacaaaacctgagaggtgctcttggacgatcctggtcaggagcactttctcttacagactaagagtatatattggttttagggtaagcaaacttattataagcttggaatatttgtgtatgtggagaagtttatggcagagttggaatctgtctgggagaaggggaggttatcttggggcagacatctttctggcctggactggggttatctagggtctagcatgtctctgcttggggaggattttggaatgtttcttgttgttggagatgttatttttggtttatggtcgtgctgaccttacccactaagctgatgctctttggatttagatggttttttattaaggtgaactttagaatgaggggcttgtccaagatggcgatgctcctgctctgtcagtgaacattcttctgtatgcattttggtgtgtatttaatagcatttctgttagaaacatacttagggccagaattgctgggttatattgtatgcttatattcagttgtaggagatattgccaaatagttttccaatgcagttgtaccaacctatgctcttaaaatcaatgattgagaattgcagttgctttccattttatactgaactatgtcgatcgtttttaactttttgccattttggtctgtgagtagtgctattcgtagtggttttagcttgtattctcctaatgattaaagttaaccactttaaaaacattcactggtcatttcaaatcatattttgtgaggtgtgaagtgttcaagcttcctgaccacttacttttctataggattttctatttttatattaaattatagaaattattcatatactttaaatatgagtcgtcttcagactatctttttgcctatctagctatcattttggtatctgtcatctgtatacacaacacacacacacacatacacacacactacaagatcttctcctaatttgtggcctacatttttattcaattagtggtgtctttcgatgaaaataagctattagttatattatagatacttttaacaattttgactttaatagttctgtctatgccctttttgaaaactctttcctattctatggtgaaaatatctccttttattattatcaagaagatttattattttatcattcctatttaggtctacaatctatcttgaattttgatttttgtaaacagtgtggattaagtatcaagactcttttttcataaagacatatgattcacctagaatcttttttattagaacattttttcctacttctttgcagtgttgcctttgttagaaattaagtctctgtatgcatgtgggactctgttctattggtcccataatttcaacaaattatgtctaattttctaaaaccttaatatctaatactacatttttcaaataaactttgttctttattaaggttatcatggctatttttgaacttttacatttccctataaattttagaacctacttgtaaatatcgtctccacctaaaccccaccaaggaaaacccactggaatattgattgagattacaatccatctgtaatcgactttaagagaattaactgtacattattcattcatccaatttatgaatacagtataactctttatcaagtaaaatctcccataatttatcttgcatgcatgaatagatcttgcacatattatttaggcttatttctttgtattaagtggtttttaagtaatatatttaagtttttaatttgtatttgttttggatatatagaaattaaatgtatttatgtatgccaaactagtatgcaccaattttctaaattcctttgttatttgtaatagtgtatctgtagtatatctatagattatttcagatcttctaggtaaataattgcattattcttggctaatgacagtttactcctttttatttcttttctttccttattaaacttgctagaaccttcaataaaatattgggaaaaagtagtgagtgaagacatcttttacttatgctggatatcaggaagaaatatttcaacattttactgttgtgttatcttcactgtaaagactctggcatagattaaggaagttatcttttttagctaggttgccaaggtcattttatcagaatgatgttgaatttgtcacgttttctttaatttattgacggcattatgttgttaatgtggtaaattaagctgaccagctttcgaaaattaaaataattatatatgtatataccacattttctttatccattcatccactagtgaacatttagggtgtatctacatcttgattgttgtgaacaatgctgcaatgaacatgagggtgtatatatctcttcaaaataaatacccagaaataggattattggatcatatggcaattcaatttttaatattttgaggaagctacatactgttttccatagtggttgcaccactttgctatggataaactgtgagaacattatgctaagtgaaataacataatgtctgccaatcacaggaaaacaaatacttcatgattcaacttagatgactaaaatagtcaacttgataaaagcataaactgaattgtggttgccaggggttggggggatgaaggaaatggggagctgctattcaagaaatacaaagtttcagttctgcaagacgaataagttctaatgatctgctgtgcaatattgtgcttatagttaacaatattgtactgtacagtgaaaaatttgttaagacagacctcttgttacctgtttttaccacaataataacaataataatttttcattcctggggtataccaaatttgaatgagtattggcatttctatacattgctggacagtttcctaatatgttatttgagatttttcattgatatttataagagtttggcctacattttgtctttattttgaaatcattttaatatttagatattactgtttttctggacttataaaatgaagttttcctctttgcttttttttgaaaaaaaattgttgagtattggtgttatttctcgtctaaaggtatagaataatttgttagtgaagttggtgggccagactctgtgtgtgtgtgtgtgtgtgtgtgtgtgtgtgtgtgtgtgcgagtttctggggatgttttaaataaacttccactgatttaagagatataaaattattctgtctttgtgtgtgtgtgtgtgtgtgtgcgagtttctgcagatgttttaaataaacttccactgatttaagagatataaaattattctgttttatgtttgtttctgtttcataatttaatacttatgtagggatttttctattttatctaaattttcaaatttatttccataacatatttcacaatattctttttggctgcccttttacaattactttttagtgtataacttgtgcatttctcatttctttcattgttgccaagtgttcataaatgttcatcagttttattagtcttttcaaagaatcaattttgactttaacattttttttcttttttttttcttttttgatagagtctccctctgtcgcccatgctggagtgcagtagctcaatctcggctcactgcagcatccgcctaccaggttcaagcgattttcctgtcttagcctcccaagtagctgggactacaggcgcctgccaccacatacagctaattttgtgtttttttagtagagacggtgtttcaccatattggccagggtggtcttgaactcctgaccttgtgatctgcctgcattggcctcccaaagtgctgggattacaggcgtgagccactgcgcctggcctaactttttctttctactatactttttttaagcaattctccataaatttttatttttctatgacctctagttttggagggtttaatgtgcttctttttctcacttcctgcattttactttcaataactttgcctttcatttttagcagctttactatgataaacctgagtgtgaattacttcatattcattttgcttggattcatcatacttattaatctgtgttttggtaggtttcatgctggttgcacatttggttttggaaatactccatcattatctcttcaaatatgatttctactctattctcttttttcttctccccctggaaaactaattatctgacttagatgttttcatcatattttatacttttctatattcaaaaattgtgtttttccatgtttcagtctggatatattctattcctctaagttttctaaacttcatttttggttgtgtttattctgctgaaggtgacacatccattgagttcttaaatttttaaatgtttagtttcttaaatttctcttttttaaaaaaattactgctttcaacttacttctctgacttttcatctattctcttgaatatattattcatatttgtatttaaattcactctattgattctaatgattgggatggggttgatttcattgactgtttttcctggttttcaatcatttcattctttttctttaatgctttatatgtctgtccatttactactgaaatgatagacaacatgtataaaaattgtagaggtaatctaaggctacatctggttgtatgttcatccagagagaatttgctgttgcttgtttatagcagttaaaagagaggaagaccattttaagctagcttgatagtgagaggatctgaagcagtttccatttttgttggagcctatcactttccagtttgtctttacaactaaaatatagcctgtaatgatcccaaataaaaactcaaagtggttactatctgcaatggtttgtttgttctcaataaaactcaggctggaatttgatcccccatgtgatgttgttaggtggggcctagtgggagatgtttgggttatgagggcagatccctcatcaatggcttgttgctcctctctcctcctgagtgagttctcactcttgagagactcgattgattctcatgggaatggattagttcctggaagagtgagtgattataaagtcagaacacctctcaagtttcccctctttgcatgtgtccacttccttttccaccttgttgtgatacagcacaaaagccctcaccagaagctagaggcatgcccttgaacttcttagcctgccgaataaaaaatagaataaacctgttttctttataaattacccagttgtgggcattctcttataaacaacaggaaatagactaatgaacaattacaattctttttttcttcaattcagtatgactgcctaaagctcttctcatctgtccaatctcttagccacttctgacattttcagtaaatgcctacaaattagcaaagaattcaagggaggaaataatatctgcttcagatatctgtgcttcttttccctcccagatattcactgataagattttaaatgtagtattagcccagaactcaaaaatgttcaaagctcacctggtgcttctgtcccaacttcttagcttcttatcaatgagttcaacttcaatgaattgtcacatacttcaaagggaaagtctttcttcagtccatttttttttttttctcctggatcatggccccctcagtactggctgactacttaaacttaaacaaattaaaaaaaaaaatattcagcctttctagttgtcttcagaggagggcttgcctaatctatcacaggaaaatgtggaagtagctgttcagtttctattatgtgacttaaaatttaagtctacttggattagttattgagcatatgatacctaaatttttcaggaacttaggttttgaattttgtgtcacttcttgtacaatgattatttctaaaacttaatctgaatcccagtgtaatttttgattatttactcttcctctatacctatacgttttatttggaaactatattaaataaatgtgagaagttcacaataggtttctgagtgtcgtggggatattttgtccaggaaaaacatgttgcctcaaagtgaaatgtgaatggaaatgagcccattctgtgtttatgtacagaaatcaaggtctcttaagcatcttctaattggtcttttccatgttattagagagactcttactaacaatgacagggtactgaacaatacagagatagacattttatcagaatattaatttaatggtttaaggcagttctctatttgacgattcaggtagaaggaaaaaaaagaaagaaattccaagagggatgtgtgtgtgtgtgtgtgtgtgtgtgtgtgtgtgtgtgtgtgtaaataaattaaattatctcttctatctacatttttatgtatatacctttggacacagatttgtattaaagatcacatttaatacattgttctagttcagttttaatgtctagatttagatagagtgggtttaaatattgtgcaaccctgggcaatttgcttgctttgcaagctacagttgcctcatgtggaatgtgaacatgtaaaattatgtacttcagtttcatacatatagtctttccttagtatctgtgggggattgattctaagaccctcagtggattctaaaattcgtggttgctcaagtcacttttataatagctcaaatcattatcatatagtatatacatattcttatatactttaaataatccctaaattacttataataactaatacaatgaaaatgctatgtgaggctgggcactgtggctcacacctgtaatcccagcactttgggaggccgaggcaggtggatcacctgaggtcaggagttcgagaccagcctggccaacatggtgaaaccccgtcacaactaaaaatacaaaaattagccgggcatggtggtgcacacccgtagtccctgctactgaggaggctgaggcaggagaattgcttgaacccaggaggcggaagttgcagtgagccaagatcatgccattgcattccagcctgggcagcaagatttttaagattctatctttaaaaaaaagaaaaaagaaaagaaaatgctatgtgaatagttgccatactctattgtttagggaataatgacaagggaaaaaaagtctgtacatgttcagtacagacacaaccatccatttttttccagttttttttaaatctgggttgattgattccacacatgtagaacccagggatatggagggccaactgtatatataatatttagcagaatataggcataagcatatattgcttaggacaatgtttggtaggaaaaaaacactacatacattatcatagttatcattcaagtaatttttttcatttacctgactctaaggttgaagggaatgataatttttcttctctttattcctcatatgcagcactctgcagagaacttagcaagtacaatgttacttgttagattttactaaatgaatcagtaatgttaaataatgcaggaagtttgaggaaagtatgaggaaaatatagatttgaaattatgaagtccctagtgacctgttatgatataaaaagaaataaaacaaactgggaggtgaggtttatattcattgatatcctcttgaagcctgtcttattgcttaggtgttcaataaaaaaattactgatttaatattgcacttagcaccgtgcaatcaccttgattgtgctctcagaggctgtttggccttcataaaagaggcaattaagaagaggagaaatatttttgaaaaggtgttatcccagcacagtcatgtaacaggaaactctaagcactagtcccactgataaaaatttacaagcttaacagaaggaattagtccaattcagtggaagaagggattatagcatgaaaactggaagatcatcctaagaaaggaaacttcatgaaaaaacagacaaggttatataaagctatggatacaatagctcattcaaagtgttttctctgttgaaatggatcattttgcttactaaattgttgcacattttatacaatagcctcaatttttgcatttctccaaatggctataatatgatgagagaaacaaaagattgggtaacacacaatgtaatcaatctatttataaagatatttatcagcctctcctatttaaagcatgcatatgacgtggaagcatccctggagccacaagacattaaaccagaggagataatgcctgccatcctaggaccaaaatcaagacaggatggatattccaactattctaataggtttttcttactatctgttatttcctgtaatccccacgtctttgtaagtcagtctatactgaccacacccagaattaggtcagaccgcctaagattttatctcttcaaatattaacaggcattggccttccaagtgaagaaatgcagaatagagttgggaagtgagtattaacttcatattgctgtgtaacaaattataacaaaattagaagcttaaagaaaaatgcgtgtattatttcatgctttctggatgtcaggagtctgggtatggcaactgggttctctgctcagggtcagacaggctgtagtcagggtattggcgaactgcatttctttttggaggctttctggaagaatctgcttccaaatatattcaagtttttggctgaatttggtggtctgtgggtgtaggcttgagtctccattctggtgctggttgtttgctggaggccatactcatttctgagagaccacctgcattcctttccctgtagctccctccatcaggaaagccaacaacggagattctcctctagctctctcatgtcaagtccccctcatttgaatcttttttttaaatcagaaatcaccagtcccttttaggactcacctagttagatcagatttatagagggtagtatccctattttaaagtcagcttgtttggaacctaaaatacatctttaaaatccttccagagaagcacttatctagatgagtgtttgattgaataactaagagaggtgtgtataccccaaagatcagagatcttggatgccattttagaatcttacctacacattttcaatatacaatctgatccctgttttccaatacatgtctcttaaataaaattcatcaagacacagttctctgctgtcattactgtatgtcattacttagcaggtttatgaagtatgaaatgtgctggagttttagaattagcaagatctgagtttatatcccctctacatttgtcatggggttttgagtaggttatttaatccctcagatttcctcagttataaggctagttaatcctccagtttcctcagatgtaaaaactagggctaataattatctctaaggcctgcagaactttagaaaaagtcatacagtggaaattatcttatgatatacaggtggcaaatttcaagttcctgactttttcccttcttttgaatgttctgatatcactcctccaatctacctctacttactttttatgaatcctttgaaatgagaaatattgagatttatacacctcagaaataagttgattttcagtggataacattatctttttctgaacaattctaaattttgattctttttggaattaattcattagtgttggctggggtatattcataagaaccttaatttaaaatttcaaagccaggcacagttgcaaaggcctgtagtcctagctactccagaggctgagcccaggagtttgaatccatcctgggcaacatactgagactgtatctaaaaaataaataaaataaaataaaatagagtctcaatatttttccttgcttttcactagtgtgtagagatttgagacttcctactcctcctggggtgcacggagcaatattatgtgaaaacagccaagtagtccgtagactcccactattagaattttttaaaatcccaaaatatctgttaaaatctattagtaagagatttggcaggatgatgattacacgtgggtagaacagcagtttccataataattatgtgggttgcaaacagattttgaaaaaaaaaatactgagatgcagcctaatgaatacattcattaaccttaataacatcaggtagataacaagaggaccattctgcacgggggaatcaactcagcctttcagagtcatttataaggcacatttgacagtgttattttctcaattaacaaatgagtagatgtagttatctgaaaagaaatctgtgttatttgaagttttccttttaaaacctaatttttaaacaagttatattaaacatttcttgagtatttggtatgtactgagcattataataagcattaaggatacaaagatgtgcaaagtataaaatttgtagtctactttggggaagcaaaaataaatgtagctatctttaatacaatgacaattgcaaaactaaaagcatcatgttacctctatgagagcagaaatcttgccttccttgttcaccactatatccacatatttagaatattagttacacaatacttgttcagtgaataaagcaatgaatgtcactgtattttagaagcagagcagaaggaaccattaagcccagaggagctttttgataagttgcattcaagctaaatctgtctgcttgatgaattacattttatcaaatcagaaaacatgtgagaagttaaaagaatggcactctgtgcagagggaatagcacacccaaaggcttaggagtgtgaaactattaacatatctaaggaataagaatcaatgttctatgtctccgatcaacaggatgtgtgaggttcgtctcagcagtaccagtttcatcatgataagcataactaatgatttcagtgggcaagaataactgtgtggccctagcatgccccacacatagttatatttcctgacacaagtttaatgaccactaacttctaggaatattcattcagattccaacatttttagattggtattgctcctttgggtacagaatgtacttatgttgtttgcctatggcaggtagcaccatgggatgccttcctaaaatctccatggagttgtagtattaataaataaccatgttgccatttgagagttcaactagtgaaaatccatgcccattgtatataattagtcttccatataaataaatcaagagattataaatgtaagaagtaagaacttggaaatatccagaatactaattgaggtgatcagagaataatcttagggaggcaagaaaggaatgtgattttcagtaaatgataattcagtgactggaaatctaatgatttctactgtttatggaaagattgagtaaaaaggaaagggaatgtttaatttgaaggataagtgagaaaaacccaatggactggaagctggcaatgcccattcaggcaggtcatgcctaatggactgttgactccttgagggcatggcctggaacctaccagtgtctggcacagaggaggcattcaaatgtttagtgaattaataaattgaaatgaataaaacattgagactgttactaaaggatcactcaatgcaattttcagggctacgtgtatttttctgttttccatagcaataacttataacatatatggataggaaatgaagaaagaaagaaaaaattatattgtctgcattttatggatttagatttcattaagggagatagatttttaaattatttggcatcgctgccctaacattccataatccttagacttttatcttcataattgtctaagatttatttttatatattcctgttagcatatagcactcaggaggtttcacattctagcaaaaatagattgtgatattctgcctattggttgttaagtcctatcataattattttataactataactattggtctgctttatatttcataaatttaatataatgaatgatagaaataattataaagttaaaatacttttagtataagcatacaatggtgtaaggtataaatctttacagatgtataattaccatttttctctcatatttttgaatgccaacagctattgcacagcaaacaaaaacatacatacaataatacaacagagtaggttaatatcatactggaaccacaggtacgaacattgttaacttgcatttttaacattcaagccagttgcatatggagagaatatgtagaaatccaggagaaaaagaaacgtgagagatcgtataaagataaatctgaacatcacagatcccaactcatattcattttcttcctttttcacaaaaaacctgttcttttccaatactgtccagcctaggacatggagctacatgcaatgttgttattctcctcccacgaatcattaaaaatgctcctttaccttctatgccccacaagtttggaggttctacattaagattccttataaatatggctcttcattcttactgccactcccttaattcaattctccattggtttccttgaccattgcaacatattttctaacttgattccctaaccttcatctccgacagctctaatctgtcatgtaagcttttagcagagttcctctacttctcatcatgtctttgtatcatttcccactttaaaagccatcactggttccccactacctgtatgacaaagttggaaatctttaggatggcacaaaagaacactcacaactgattctcttcagctcaccctctcattacttctctgacctgtgcaccctacatagctgcaatgctccatattcactattccttgattaacaatttttttcaatatatagaaaacaatatttcaaaatgctggtatcactctattatccatacttttcaaacttagttcaactcttatctccctaagaagtgttggtcaattatttattgatctgctctcccactgcatttaggacatgcccataataatcatttgtatgtggttacttatttatatctgtcctcctttctcatccctccactagacttgtgaactgctggagcagagtctctaaaccctatttaactcatgttttttctcagtttcaatacaatttcaacacacagtgatgctgtcaattgcattttcttcaaaatatacactgctcctctccgtgggaaaaaccatggatgcctgtcccattcaggtcaggtttagccatgtgatttgttcagtcagtgaaacgtgagcagaaataacatgtgccacttttaagcagaatcttaagaaccattgtatgattcccctatcatctgtttttccttctacaacagcggtccccaacgtttttggcaccagggactggtttcatggatgaaactgttccatctcataagaagcgcacgacctagctccctcacgtgtacagttcacgataggattcaccatcctatgagaatctaatgcctctgcattagatctaacaggtgacagagctcaggaggtaatgctcactcacccagggctcacctcctgctgtgcagccaggttccgaacaggacacggacaggtactggtctgaaacctggggtttggggactcctgctctacaagattggtatgtcccagaaacagactattcttttagacttcaaactcaaaatgaagatgacatagaacagagttataggccatctgcagtgaatataaaggctgaaataaacttctgttctataccagtgagatactgggactattgattgtgacaaaataatttagtctaagatgggtagatatttaataaatgttgaagaaaagaaggaaggttatagagacctaggaaaaaaaatagcagggtaattcaagagtcaattttgttttaaacaagaactgtctgttgaaaagaaagaaaaattaagctttcatgagtttctctttatgagaaatcataggaattagagttgaaaggagaaaggggaagagtagattgtagagaaagagagtatatttttggtaatgcaatcttgggaagaaagtgaaagtaaattctctgtagattagcatgtccttaagatgtctgcagggaatatttaaaggatctaagtatctgctagtgaggtgttttgagaatccagtacatatgtataaagaatcctcctttagttaagccaagctaagtaagttaagaatgatttttctattttaaatgtccaagttactctgattccacagccaaagaaaggctacaaacctgactaaaacaacatccagattaagactatatgtaattacagccaattcttatcattcacagtaatgttctataaacatgcagcaaacagtaaattagtgaataatgaccattactcctggaggaaatacaagcttaggttgctgtgagcctttagtcacaacgtgttcatcaactagtcaaaacataaccttgttttatgtgtgttcttgtttaaagacatcttagttaatataaattgttgactcactaacattgaacttgcagcaacagcactttattcatgcaacttatttaacatatgtattgtctatatacagttatccctagtcccttgatatttgcagagcattggctccaggacacttcctcctctcaccccaccaataccaaaatctaaagatgctcaggtctcttataccaggtagcttagttttcacatgtaacctgtacacatcctccattatactttaaaccatctctagattattatccctaatataacatacatgttatataaatagtcattatactgtcttgttttttatttgtattattatttttccaaatattttcaattaattattgatgaaatctgtgaatatggaacccacagttatgaagggctgactgtattttctatgtatattacagccatcttgtgcttagaaacactagataacacatcagctttattcttggaggccaagttaaacactgaaatcaccaataaaaaacacgaacatgcaaaagatggcgctaaatagatactgtaagtttgtagtatgaaaactgaaacaagaaagcagagtcacctttttcaacctcagatggggacatgaacttcagtagtctcaaatgtgtaccactctctgcatgcccatgaatgactgcaaaaatgccaccaatattgattctggtattgcaaataaacttcagcaagtagctaaatttgtaaatgcagaatctgtaaataatgatgatcaactgtaaatccaaacaacggaaaagaataaaatggattatgaggagttgggcaaaatgcccaccagtgagaagagggagaaattggatggatggataaataataaatctagtaaagtgccttaaatgtggtagacttttagcaaatgttagtttccttccccatctttatccgtttgttttctcttgctttggtaaaatacgtgtcacccaaaaaattaaagtagtacaagaatattgaaggtccactctatcaaagtaatagaaagcattaggtggcagaaaggttttttcttagcatttcattttactgctgaatttattgcatcatacttaaagatgccctatcatcttaatgcaaatcttaaaagcatatttatataaaaatgttaatgtttaataagctaaagtcaatacagcaccctctaatttagccagtgttgtcttttttgggattaacatagcagatattatccaaaaatttaaatagaatgaccctgttttgtcacatagatattgggattttctgtttacacactatctcctttatgatttatattgtgctgttaattggaaacatctgaaacaaaaattattttaaactcacaactctaacttataaggctaataataaaacatcatagttttctaagttattaaacttacagaaaagatatatacctcaaaaaaaaaaaaaacagagaaagtacatgatgagagatcagtaaattatcactctcatcctgacagttttcttttatggaaatatcacctgcaaaaaagtttatcaagacaaactttttacaatccctgttaaattcaatgaatgaactgtgaagggtaaattggagccattataatcttacatttcttatgtaatattcataatcatagtgttacataagagcgagctaatgttaacaaaaggagcaatttaaattcccacttccttggagaatgggtctctgcttgaacaaacagagcttcctgtcccatttgcaacacgcccatgctgctcctcgagtgccaatgagacccacactctcatctcagtgatataataaaccctccaaaacagaggagaaaatgaggcaaacaagcccacttcatttcaacttgtcaggtttaaataaaatcttctggagctgaaaatgggaaacttgagggaagataatgtgtgaagtaaccaaattcaacattgggacaaaacatactacattactatatttttgtcttgatctgccacaaaagtttttgaaatttcactataggtaatttttaatatctttttgtcatggaggacttaaagaaaaacagtgttctttctgtttattttttcccttctctccacccactgatgccctagctaatatctcaagtcatctcaagcccttatgatatcttaataagtaatatatgacatttggaataactcccaattatcaatatttatatcaaagttggcacagcactgcatactgaaaaaagtgcatgctttctgtataatttaaattaattacttacataatactttctcggcactgattttttatgcaaaatattggaccatgctttctgcatagaaaaaaaaatgttaagggcaaaaatgcattgaaaggaaagtaaaaataaattaacattctgttaaatggaaatatttgaatatcaccgaggtaagcagtgattggtagtgtaaatctcttcccacgtcctctccccactacccactgcccctactcccagctcacctcctaacactttttcctgctttgcatttaggaggctctagtctgttcttccccttaaatctctctatattccttctcttctctctttgaggttacttgtaatttagtcaaattttccctttccccatacttcctttacaagcacttgcacttcttccagggaaagacagtaccactgggttccagcagacatacagcacaaactgtgtatataccaatggcagtgaagagggacaagtcactttccttcttccttagatgccctagggtgtacccaaattgtatacaaacatcttttcatgccttttatttttatttccaatacaatgtttcatgtattttccaaatcattgtagaagactttactttttcttattctgttatactctcctctagcattatattatgagccctctgatttcaaaaacttttatcttaaaattcctaaataactttgagtgagcagtgcatagaatgatagttatgttgaggagtatgatcccttcaccacttttgatggcacattgttcagaagttcttttgggcactctaatataaaatgtgatttcagatgtacatttttaatgtattttagagattccatgggatagaaaatagtgtatggactatggactacaaagatttcagttcgaggcttggcaaatcaacatttaatagagtaaccataatcggcaaacggttttttaaacctattattcatttgtaaaatttgatcaaaaatgttgtgtcacaggatgattaaattaatattaggtatgttggagaatatttttaattcttattttatgatcattataattattattataaagccaaagaaaataatgtatttaaagttaactttacctggctattaaatgtccattaaaaatgtgaatgatgatattatgcagcttccatgtatatactatattttgcagccagtaaaattgtgccagaatctccaggttattttctgcagtttaaggtaagtgaggttagtgccttttagcactcttaggcccaaaatttccatggtgttattgcactttttattctaacaagcttctatatcaataatcatgtcggtgtaatataggaccatcatggggcctgaggtagccatttaatgactaatcttgtcaaaaggaaagcaaatggactcatttgcttaggagatatctgttctaagctgagggtttttttatttccccacagtgatggctgggctgacaggtatgatgtgacagatggatatcagcgagaagctgttggtggcatcacaatcaagctccaatctcccgatgtcaagtggtttgatgattattatctgaagctccggccagaaacaaaccaccgaaacccttggtttcaagaattttggcagcatcgttttcagtgccgactggaagggtttccacaggagaacagcaaatacaacaagacttgcaatagtaagcagatttattatttcatttaaaatgcataaggctaaggttccaatttaagtaaaccatgtcatggggatagtggctgtaatatgttacaagggaggactcttacataagtagagtggatattgccacttatggtgataaacaggttttagtctcattaggaaaaacatatcagagcaagtatttagtgatattttatgtgattagatcatttctatttgtatcattcaaaaaattgaatgtatttccataaggcattgtgctaaaaacatcacatgagctccagaatggaactatttctgacatccttgaatgcagtgactgcattctgctcatttctattatccagagtagttagcacagtggaagcacatagtaacggtttcatatatgtacaaagaatgaatacatgagtgttgaaggacagatcgagttgctacttccatcaataaaccataaaatagtaccagggatttgctatataaaattgtgatgtttcaggaaacgtaacctatgtagagccattcattcaagcattcaacaaatacttataagatgctaagaatgtaccaaattttgctttagttgtaaggataccaagatggagaaagctagttcctgccctcaaaggtttactatcttggaagggagatagtaatgccaacaaaaattgcaattgaaaattataagtgatatgataactaagtgtttaaaataagagcttgggttaatattatttgtaacatgtccaaaaagaatcttgattctaataaccaggtagagccagcatatactttatctatctatatcatctgtctatcaaatatctgtgcctgcaaaggttaaagtttgtaaaaattgacaaaggatttttttttggaactgacttatcctacattgtgttataagaaacccatatgcatttgcattgcaggaaaatgcaaattgaacatgaaacattgttcaaatttttgaatgatataaatagtaataaattatctaaaatcttactagagtaaatacttgctctgataagtttttgttagttggtggtatagatgcctttacccatggtgctggaacaccagaattcagtggggcagtgggcttgaaatcctggtccattacccaattctagtccacaaagaggttgtcacataccagcaataaaatgataaaaacagaaacaatttagtgagctattcataaagatttccccctctgaggtcatgttcatcctgtgtttctggtatcagattgttcttttgggaaatgatggagatagtcaatggtggtttgtgattgtttttaaatgtaattgcttcataaaacaagaacccagcaatctcatatcagttcctatttgggtagaaggggaagggaggaatgctggagtgtgggataatacacccatcaatgaaatccagaaatcattgcaacatagtgtgagagtatgtttgcttctctcccacttcagatccttgtaactctgaccaaatcctcaaatgcttacgcatttcctttgctttcattttttatggcaaaatacgtgagaaacaatagcactgtcacttatggctcacaatttcaaatttgtagctaatgtcatattttaacagttctatctagtttctgaagaaaacagatttcttttctctcttgagatttggggatcatatgtccttctgtggtctattctatgtttgtataattattactatgtgtagcttcattgaaggagttctgaaaggtaagcagtagctctgatttcatctttagttcctctttatgaggaattagtgacaacactaaccggtatatttaagggaatttttccagttggcctgcaccctctttctttattaatttcttcttttcccactgttttttggtctgaaatgcctcctcttgaaaatagttatttgtttctctgactctttatttcctggaagtcctgcttaaatacagccttgaaaactttacttgatttccatgaaaatattatttctatggaaaccgttctgtaaaatcctcccttgaccttgctgctgtagctctctatctctcatgtgagcaccttggtgtgatctctgctcagaatctgttctttactgcagtcatggaaagcaccacttagtccatccccccccttggaatctcgtctgacaacagatgtcatttggtacataggcatggacactttatatgtactgcctctgttattcttcttaatgagagatgtataatattatcctcattttaaatataacaaaagcatgatttagagagacaaaataagttcctccagtcatatgactattaaacattggaacttaaaattgaactcagatttgtctagagtttagccaacatgctaaataaattaaatataacagattaaaaatcaccatcaaatctgcattatataatagtcaatatatagttcaaagatacaaggaaaataattattagatttatgtcttactatgaagtgcaataaaaggtactcaaatattcactacccactacttttgaccctagtttcttatgtaatccaatatcaattgaacatttcttccctatcatgtatgagagtttaagtttttccacacccttgttaatacctggttttttcttctgtatttgacaatctgtgagtgtgtagttctatcatacggtgatttcaattggctttttcatgatgtatttcaaagttaagatccttttcatgtttttggaaagctggtatcctcttttgtgtctgttcaagacttttgaacatttctttgagtttattatctttttaatatctattggaaaaattcctcatatagtatggacatgagtcctttgtcagctatataaattgtaaaattgacaaaacagaagtttggcttttttattaccttactgtatctctcatttactacttgttttctttttgtccaatttgttatttagctatttattcctctgtcttttctgctgttttgtattaatcaataatttttattattccctttctcttaacatttttgtttcatctctttgtataatttatttggagttttcaacagaaattaccaactgagtccttagtttaatatagaatattttaagttggttcttatcacattcaagaagcttgcaaatatttaaatctatataccccttcagaattttttttgcaattgccatatagtttacttttatatgtactctgtataccacaggactgtgttatgattatcataggtgatcaatagttttatatttattgaggctattgttcttcattccttcttgtacttccatgctcccatctataattctttcagcccgaggaaatttctttagtatttcttgtatacgcagatatactgccaggaagttgtattagtgtatatttttcttagaacattttcatttcaccttttatttttaaaagatattttcactgagtatagcatttgatattggcaggttttcttttgtttgcttgcttcattcttatttttttcttaaaaaatgtcatttcattttcttccagattttgtgatttcattgagaagttagccatcattcttaatgtgtttccccggtgtcaatatagcaaataaaattagcaaataaaatttcaagaattttaaaattacatatatataatatatatgtaatatataaattatatatagtatatatgtaatatataatatataatacataataaatgtcatatataatatataatgcataatatatgcaatatataatatataatacataatatatgtaatatttaatatattatgtatatgtaatatgtaatatatgtattacatatatatgtaatatgtaatgtataatatatattacatatatataatatataatatatatgtaatacatatgtgtgtgatatatatactatatatacatatatgtgtatatgtgtatagatattatatataacatatataatatatacatacacatgtatgtatatatgtaataaacatatattacacatataaaaatattacatatatatttaatatatattatatattttaatatatgtattatatattataatatatatattatatattatgtatattaagttttaatgaccataatgaactttggtgttatttcctttgtatattactttcttaggttttccagagctccttaagcctgtagaataaagaattgcatcagtttaaaaatttcctcttaaacattccttctgctgcatttctctctccactcctactatccaattacaccgctgttaagccattttaccatgtcacacatatgacttattctctgtgtagtcttttcttttttctatgattcagaaagaaaatttggcctatatcttcaggaaaaggccaactaaagtgtgaggagtctacattcctcaagtgagcttttcttacaaatattacaaaacaatgagagatttgaatatctctcttgaaaatctttttttttttattatactttaagttttagggtacatgtgcacattgtgcaggttagttacatatgtatacatgtgccatgctggtgcactgcacccactaactcgtcatctagcattaggtatatctcccaatgctatccctcccccctccccccaccccaccacagtccccagagtgtgatattccccttcctgtgtccatgtgatctcattgttcaattccaacctatgagtgagaatatgcggtgtttggttttttgttcttgcgatagtttactgagaatgatgatttccaatttcatccatgtccctacaaaggacatgaactcatcattttttatggctgcagagtattccatggtgtatatgtgccacattttcttaatccagtctatcattgttggacatttggattggttccaagtctttgctattgtgaataatgccgcaataaacatacgtgtgcatgtgtctttatagcagcaagatttatagtcctttgggtatatacccagtaatgggatggtgggtcaaattgtatttctagttctagatccctgaggaatcgccacactgacttccacaatggttgaactagtttacagtcccaccaacagtgtaaaagtgttcctgtttctccacatcctctccagcacctgttgtttcctgactttttaatgattgccattctaactggtgtgagatggtatctcattgtggttttgatttgcatttctctgatggccagtgatgatgagcattttttcatgtgttttttggctgcataaatgtcttcttttgagaagtgtctgttgatgtccttcacccactttttgatggggttgtttgttttttccttgtaaatttgtttgagttcattgtagattctggatattagccctttgtcagatcaataggttgcgaaaattttctcccattttgtaggttgcctgttcactttgatggtagtttcttttgctgtgcagaagctcttgagtttaattagatcccatttgtcaattttgtcttttgttgccattgcttttggtgttttggacatgaagtccttgcccatgcctatgtcctgaatggtgatgcctaggttttcttctagggtttttatggttttaggtctaacgtttaagtctttaatgcatcgtgaattgattcttgagcctctcttgtagcccccagaatcagcaagtgaatcatgcgagaaaatggttaccatacttttggggctcctggaatttataaagcgtcatcttaataaccaaaagcattactggttcttctttttctaaggagtgtcttatactttttttaaggagtgccttatactgggttgaattaccacttgctaccttttcctcaattcatgtcttttgccagaacctcaaagtatgatcttctttagaaataggctcattgcaagtataactaataaagatgaagtcatactgtagtagggtaggcccctaattcggtatgatagatgtctttataaaaagaggggaagagacatacagacagaaagggagacaaggaggacaccatgggatgacacaggcagtgactggattgatgcaggagcaagccagggaatatcaaggattgacggtcatcaccagaagttaggaagaattctacccagagtctcagagggagtatgacattgctgacacctgatttcagacttctagcctccagaactgggagaaaataaatttctactgtgttaagccaaccaatttgtggtttttttttttttttttgtaatggcaaccttagaaaattaacattccttcattttaaccaagagagatcctcaaactgaattttgcagtcagaacctgcaagtatcctaggcaacaaaagaagctgatgacaccctccttctttgctgctcttctctttgtgttagttcattttgtctttgttgcttctatatatcttcactgcctttaagatttttgactttcccatttctttcaccttttcaagtatgcagtaaaggaattttcatttgcttccttctccatcctacctaacaccagttcttcctctactctttattcttagttgttgctacttctgaaatcctaatgctgttgtataaataaagcttgtcgcttacaatgcctaaagtgtttgtagccttgttaatttttgtttccttctaagcatttaaaaacttaaatctaaatattactatggcccttaaatgttttaactacttggtattatttgagtccagaaatatatactattaacagtgagcctgacttcagtatttttacttaaatggcacaattatggaaaacttaaattataagtcgaatttaataataaattaaaagtaataagaagtattaagagtataatttttctctaatagtatatttaacagtaataaagtaagctacaaataattaagttaaaactgtttcctaataactacgctattctattttttaaggatggtttcctttacagccatactgtaacttgctgacattcatttattgtatcttttctataatttctccctgtcatctccagtagtttccaggagtgtcacttaagacaacaaacagacattttcacctaaatttcctaaaagcatctcaaacttaaacatctaaaattaacttcattataacttctataaccaccacctcaaactttaggttcctcctttttatatccccagttgaagtaaatgatacactcatccatgctgtatctcaaggtgtaggagtgagtagtcctcacctcttccatccgcatagccaactggtgacaaaatagtgttcattctattgttacaccattttatacttctgttccctccttttcattgttacctgaattcacgtctctgttctactgttttcagtataatttttattgtccctcaccttaaatattaaaatccccctatctaatgtttttgataacagctttttccttccccatttgatactaaaaattagtttcaaaggtcttcacctaaagagcaaatctcatcaatgttactcccattcttaaagatcatccttggttctacaatgtctacaaaaggaagccaaactctgcctcagtcaaaactcttcaaattggtcatttatattctttatgcctcatctcctatttcttaaacccatgaaatctgtgttcccaccatttcatgaattgtgatctttcattttaaaattgcatgcccagttaagctcctgtgtttctgtacatgctaaatcttgctcagtgaaaagtccacttcaagacatgtatcagttccaatgaatttacactctcatggtttctaatcgctccagttttctgttcttactttgactttaattttctcacttttcacctcatttaccttttgtcttctttttgctacaagggaatccagacactgagcacagatatacttccccattttttgttcccccaaggaactacgcacacaaccatctctatgtgtaccaaactactgttaataaaatgaagattaaatgaacgggttcagagcaatgtaaaagtacattggcaatgagatttctctgggttgtagcaatgtcatttattgattcagtggtggttatcagggtgtgtttatcttaacaattcatgtaccattgtggtttttgaacttctttacattaatgctttactgtctaagtgtttaccttaacaaccactcccctataaaagtgaccctttggtcactaatatagtgaccaaaataaatttctttccctgtagcatttccccacagtgctctcctgtacacactcccactcctttacaagctttttgccaccgtggtgcttaattctctccctttctttctctgtaatctttccctcctctcttctcagtatttctacacactaacacaagtttctctccacttcatgtgtagagctatttagctgtttctttgtttccttgtattcttcaaaaattctacccttggacagagatgctcaccttttgaacccaaaactgctttgggataaagttactttgccacacagaaagtagtttactgcagaaagaaaaatgataccatccacagatgctgaagtaactacagtcaacagaattttttcttgctgtattacatcaacaaataagtagaatttttcaaattgttagaccagcatgcaaacattttatattcatctttctccattaaattataaatgtctcaaggagaggcgctatctttatcatctctgttttccaaatccctatcacaatgccttgaatataaggcaagcattttataaatgttgttagataaatgctgctttatttctcatagtgttaaaaagctagaggacctaggaccgcagtccccaatttgtgggatgcagggactctgggtcactgtagatactttgcctgggtctaaaatctacatataactgaccattgttcatggactgaagtgtgccttgcatattcttgtgtgtatgtacaaactgttgccgttacaaaatcataaattaagaattattgaaatcatagttgtttatggccattatgtgcttactaaatcaaaaatactaaaagtacaaataatatttgtagaatgtgtgcaagtttttcacattcaaagagtttatattcaaaaaggttagtctcactagcttagaagtgtttcttcttctcttaaagtaagtttcaatctagagttgtctacaatctctctgatgaatatgtctcactagtatttgaagtgggttgttagaggatacttccttatgcatcagaatgttgtcttctgccatcttttatgccctttgaaatgttcattaatggcttagccatagctcagaacacttgagtatctctcaaactgaaaatatgactggggaaaataaaaaaagtctactgaaagaaaagaattgcttgggagagagtagctagaatacaggaatagtactttaagagccaaataaaattaaattaaataactgctacagctaacacccagatttgagattcctcatccttgtaccacattaacattttcaagattgtatttggagagaacagtaatctagtgtgagaaaaggattccatggttacatttttggggattattccctaatcttattgtagatcataagatcttccttcagaagggatcctgttccatattctagaggaaggaatgctgcacagaaaggctgatatagtttggatatttgtttctgctcaaacctcatgttgaattggaatccccagtgttggatgtggagtctggtgagaggtgattagatcatgggggatatgttctaatgaacagtttagcaccatccccttgaggctgttcttgcaatagtgaatgagttctcaccagatctagttgttgtaaagcatggcaccttacctctaccctactctgtcttttgctcctgctctggccatatgatgtgcctgctctcgctctgccttctgcaatgagtaaaagcttcctgagacctccccagcagcaggtgccagcgctatgcttcctgcacagcctgcagaaccacgagccaattaaacattttttttcttataaagtacccagtcttaggtattttttaataacaatgtaaaaatgacctaacacaggaaattggtatcaaggagtgggacattgctataaagataattgaaaatgtggaagcacatttggaaccaggtaacaagcagaggtcaaaagatttgggggagctcaggaaaagacaggaagataagggaaagtttagaacttcttagagactagttaaatgttagtgaccaaaatgctgatagtgatacggacagtgaaattcaggcggataaagtctcagatagaaattaagaagttattgggaactagtgaaaaggtcatccttgtcatgtcttagcaaagagcttggctcattttgttcattccctagagatgtgtgcaagtttgaactaaagagtgatgatttacagtatcttgctgaggaaatttctaagcagcaaagtgttcaagatgtagcctcactgcttctatctgtctgtgctcagatgtgggagcaaataaatgacctaaaattggaacttatatttaaaagagaagaagaacataaaagttggaaaaatttacagcctgactgtgtggcagagaaagagatctttttcaggtgataaattgaagcaggctgtggagcaaccacttgctagagatatttgcccaactaaaagggaaccaagtgctatccaagataatgagggaaaggctgcttaggcatttcagagaccattgtggcagctgcttccatcacaggtccagaggtctaggagggaagaatgcttttgtgggcctggtccaggaccctgctgccctttgcagcctcagaatgttgttacccacatccaggccactcaagatctagctgtggctcaaaggagaacacatacatcttgcactgccactttggagaatggaagtcataagctttggtggcttccacatggtgttaagcctgtgggcatgcagactgcaagagtgaagaatgcctgacagcctctacctcgatttcagaagctatatgagacaaactgggtgcccaagcagaagcctggtgcagggttggagccccaacagagaaccactaccagggaagagtggataggaaatgtgggcttggagcccccacaaacagtccccaccagggaactgcctagtgcaactgtgagaagggggccaccatcatccagaccccagaatggtagatccactggcaactttcacccttcatttggaaaagtcacaggcactcaacttcaacccgtgagagtagccatatgggttgaaccttgcaaagccacaggagcagagctgcccaaggccgtgggagcccaccccttgcacccacatgccctagaagtgggacatggaggcaagagagattattttggagctttaagactggataactcccctactgggtttcaaacttgaatgggtcctgtagcccctttcttttggcaaatttctcccttttggaatgggaatgtttacccaatgcctaaacccccattgtatcttggaagtaaataacttatgtgattttacaggttcataggtgtaagtgacttgccttgtctgagatgaggcattggacttgggactgttgattgggttgatgcaggaatgagttaagactttgggggactgttgagaagtgattgtgttttgcaatgtgagaatatgagatttgaggggccaggggcagcataatatattttggtaatgtgtcctctctaaatctcatgtcaaattgtaatccccagtgttggaggtgggtcttggtggtaggtgatcggatcatggtggaagttttctaatgaatggtttagcagcatcccctttgtgctgttctcatgacagtgagtgagttcttacaggatctagctattgtaaagtgtggcacttgtcccagcctccactctctctcttggtcctgctctggcatgtgatgtgtgtgatcctgcttcaccttccaccatgagtaaaagcttcctgaggcctccccagaagcacatgtttgtactatacttcctgtacagcctgcagaacggtgagccaattaaacttcttttcttattaagttcccagtctcaagtatttctttatagcaattcaagaacccccaacacagaagccaagaagaatctacactttttgtccaatcatatttttacagtattgtcagtcatgtctaattaacggcatctctataaattacaaagagagagggttcagatagcctcccaatagctgaactaatggaggttcctgaggatgatgcacccagggagagcgtggaagctccacacccctccccctatacctcactgtatacatctcttcatgtgtatctttgtaatatcttttataatgaactggtaaatgtaagtttctatgagttttgtgagccactgtagcaaatcaactgaacccaaccagaggtcatgtgaatgtcaccttcaagccggttggtcacaatttctggaggcccagacttattactggtgggaagagggagggtagtcttgtgaggactccattaacctgtgggatctgatgccatctccaagtagatagtatcagaatttaattggaggacactcagctggtgtttgctgcagaactgattgcttgcttattcatggagaaaaccccacacatgtggtcacagaagtcttctgtgatgattgttgttgagtgagagaatagaaaaagtagagttcaagtttttactctcagaactctgaactcacattattatttaacactgattagcaccatactttaggaaagactatactagaacaataataacagacattgaagaaaaattttgatcacatgatactagtgcatgtagtaaaatatcccgatcagaagcccatttgtgtcttcatatcagacaaaattaattagaatttcatgtgacactattggcttaatacccattcttgaattatttgtattttgatatgtttcattgccaaaggaatgaaagtttgtccacgttggagtcagcattaaggaaatagaacataaagctatatcaaagccccagctatggaagttttgagagaaataattttacacatttcttatttaaattccagagtttaagaaatgattgtaattatccactcaagtaagtgtttagtgcaggcagttttcaatgatgaatatccactgtcaaaaaatactcagtgagatcccagaagaaagcccttaatttaaaaagaccaattttctacaaactcctaaggcactagaatttgaacccaaggtatgttaaagatacttaaaattcaccaaattgagacctgataagcttgttgaagaatacaaaaaattagctgggcgtggtggcaggcacctgtagtcccagctactcgggaggctgaggcaggagaatggcgtgaacctgggaggtggagcttgcagtgaggagagattgtgccactgcactccagcctgggtgacagtgcgagactccatctcaaaaaaaaaaaaaatgaacttgcagattatcatgaggcttacatatgatgatgtatgggaaaatggctgcttcttttgaagatgaagtaataaaaatggaatttactctcctgcttgaaataacaacagcagcaaaaccagacaaaattcagaaaacaagtttgcaagacactggacctcaaacaatgaagacattattctcaagagacaagaaataaaagatgtgacccttctaaagtgagaaaatggaattgagtttagagaggtcaacaaagctagagtttgtagagcacagaatcagagaggagagaactgcgtgaagagagaatgctggagatgtgtagaggctccctcctgagcattcagcggagtattcatcaaacacgcatgacccgggacagaaccacttaaaacagaacactgttcccagcaatcatatggtaacggagtcagaatggaaaaaacacgtagttcagatacctcaaacaatattttaaggacatattctagcattaaatattagggaaaaaaaccacaaaccaatggccacagcttccacctcaagaaatttgtaaaagaaaagcaaattaaccacaaagtaagtagaaaaagtaaataatagaccagagtgaaaatcagtgatacagaagacagaaacacaatagagaaaattcaataaaattaaagcctgtttcttttaaatgatcaataaaattgaaaaatcaaattgatcagaaaaaaaagaaaagagaaacaatacaaattactaatatcaggaatgggtgaggcaacatcactacaggttttatagatatgaaaaagaaaataaatactatgagcaactttatgacttaatttagataaaatgaaaaaaattcattgaaattaacattctaccaatgttcactggaggataaagagaaaatatgaatggtcctatatttgttaaactgaatttatagttaaaaattttcccacaaagaaaactccaggcccagattggtttcactggtgaactgctgccaaacatttaaggaaaaacagacatcaattctatgtaaactctaccagaaaagtaaagaagtagaaatacttcctaattcaatcaatgaagacagaattacaggtaccaaaaccagacgaaaatatctcatggaaaacaaaacaaacaaacaaacaaacaaacaaaacaattataccccaatatacctcatatagacctcatgaacactgatgtaaatatattaaacaaaattttttaaatcaaatctaataatacctttttttaaattttattattattatacttcaagttttagggtacatgtgcacaatgtacaggttagttacatatgtatacatgtgccatgctggtgtgctgcacccattaactcgtcatctagcattaggtatatctcctaaagctatccctcccccctccccccaccccaccacagtccccagagtgtgatgttccccttcctgtgtccatgtgttctcattgttcaattcccacctaagagtgagaatacgcagtgtttggttttttgttcttgcgatagtttactgagaatgatgatttccaatttcatccatgtccctaaaaaggacatgaactaatcattttttatggctgcgtaggattccatggtgtatatgtgccacattttcttaatccagtctatcattgttggacatttgggttggttccaagtctttgctattgtgaataatgccgcaataaacatacatgtgcatgtgtctttatagcagcatgatttatagtcctttgggtatatacccagtaatgggatggctgggtcaaatggtatttctagttctagatccctgaggaatcaccacactgacttccacaatggttgaactagtttacagtcccaccaacagtgtaaaagtgttcctgtttctccacatcctctccagcacctgttgtttcctgactttttaatgattgccattctaactggtgtgagatggtatctcattgtggttttgatttgcatttctctgatggccagtgatggtgagcattttttcatgtgttttttggctgcataaatgtcttcttttgagaagtgtctgttgatgtccttcacccactttttgatggggttgtttgttttttccttgtaaatttgtttgagttcactgtagattctggatattagccctttgtcagatgagtaggttgcgaaaattttctcccattttgtaggttgcctgttcactctgatggtagtttcttttgctgtgcagaagctctttagtttaattagatcccatttgtcaattttgtcttttgttgccattgcttttggtgttttggacatgaattcattgcccatgcctttgtcctgaatggtaatgcctaggttttcttctagggtttttatggttttaggtctaacgtttaagtctttatatcatgaaaatggccatactgcccaaggtaatttatagattcaatgccatccccatcaagctaccaatgactttcttcacagaattggaaaaaactactttaaagttcatatggaaccaaaaaagagcccgcattgccaagtcaatcctaagccaaaagaacaaggctggaggcatcacgctacctgacttcaaactatcctacaaggctacggtaaccaaaacagcacggtactggtaccaaaatagagatatagatcaatggaacagaacagagccctcagaaataacgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaactaataacacatttaaaaattataatacattattaccaagtggtgtttatcttgaaatgtaaggttggcttaatattcaaaaattgattcatggaattgtattaacatataatattttttaatgagaaaacctattataataatttttgatgaaatgactcacaaactaaaaatagacagaaactctttttttttttgagacagtctcgctctgtcacccaggctgtagtgcagtggcacaatctcagctctctgcaacctcccctcctgtgttcaagcctctcaggttcaatcaattatcctgcctcagcctcctgagtatctgggattacaggagcataccaccaagcccagataattttggtatttctagtagggacagtgtttcaccatgttggccaggctgttctcaaactcctgacctcaagtgatccccccaccttggcctcccaaagtgctgggattacaagcgtgagccaccatgcctggcagaatctttttcaatctactaaaaatatttttccctgtggtcaggaaaggaggttggctttcaattctataggttctagtcagtgaaataagtcaagaaaaaaataagtgatgtccagattttaaagaatggagtaaaactctattaacagatggtataattgtctttctagaaaagcagtggtgtttacaaactaagttctagtgagtttattacatttttgtaatagaagatatgaattatagaaaaatgaattgtatttctatataatagcagtaaataattagaaactaaaattttaatacattagtatcatttactggatatccacatgtggaaaaataaaattggacccttacttcacaccatagacgagaatcaactcaacgtgaattaaaggcttaaacataagacctagaaacataaaactactggaagaaaacatatggaaaatcttcctgatagtggcctggacgatgattttttggggggtatgaccccaaatgcatagcaatgaaaacaaaaatagacaaggaatttaatcaaactagaaagctcatgcacagcaaaggaaacaatcaacagagtgaaaagacaacctaaggaatggaagaaaatatttgcaaccatatatctgataaaattcaaaacataaaacaaatgcaaacaactcaatagcaaaattaaaacatacacacataaacacaaataataacatatctaaaacctggactaaggatttgaatacacatttctcaaaagaagatatacaaatgtccaacagatatatgaaaagtgcttaacactgctaaccattagagaaatgtaaatcaaaaccacaatgagatatcatctcacacctgttagaatggctactatcaaaaagatgaaagagatgacgtgttggcaagggtgtagagaaaagggaaccctgtatactgttggtagaaatgtaaattgttacaaccattatggaaaataggatggagtttcctaaaaatattaaaaataaaactaccttatgatacagcaatcctatttctggatatatatccaaaggaaatgaaaccagtatatcaaagaggtatctgtacccaatgctcatcacagcattagctgcaatagccaagaggtggaaataatctaaatgccaaaggataagctttttaacaaatgctactgaaaaatttttatatccacgtgcccttcctccccaccaaaattcagtctacaccttgcaacgtagagtcatgtgctacataacgattcagtaaacgatggtccacatatacaacaatggtctcatcacattataatggcgctgaaaaattattgttgcctagtgatgtcatggtgcaacacattactcatatgtgtggtgatgctgatgtaaataaaccctgtgcactgccaattgcatgaaagtatggcacatacaattatgtatacaacataattttgaaaataataacgtttatgtatttactattatatatttttatcattacttgggagtgtactccttctacttataagaaataaaaagtcaactgtaaaacatcctcaggcaagtccttcaggaggtgttccagaaagtattgttatcataggagataacagctccgtgtgttattgcccctgaagaccttctggtaggatgagatgtggaggtgggagacagtgatattgatgatcctcaccctgtgcatgcctaggctaatgtgtgtaggtatcttggtttttaacaaaaacatttaaaaaataaaaaataggaaaagattatggaataagaatataaagaagaaaatattttgtgcagctatacaatgtgcttgtgttttaagctatgtgttattacaaaagagttgaatagttaaaaataaattaaaagtttataaagtaaatgttacagtaaactatggtgaatttgaagaaagaaaaataatattttttataaatttagtgtagcctaagggtgtattgtttataaagtcatagtggcatacagtaatgtcctaggccatcacattccctcaccctcactcactgacttgcccagaacaacttccagtcctgcaagctctattcattgtaaatatcctatagaagtataccattttaaaaccttttatgtcacacttctgctgtactttgtctacatttagatatacaaatacttacacctttgtataattgcccacagtatttagtacagtaacatgctgtacaggtttgtagcttaggagaaaccagctatatcatatagcttatgtatttagtaggttgtgcataaccaccctctaagatgttcaaacagtgatgaaattgcctaacagcacctttctcagaacatatcattgtcattaagtgatgtatgaatgtatataaaaattaactaaaaattaattttagctagttatggtggctcgtgtttataatctcagcactttggaaggccaagtcaagagaatcattataggccaggagttcaagaccagtctaagcaacaaagtgaaactaccccctgcctctttacaaaaactaataataaaaaaatttagtcaggtaattgggcacagtagtgcctgcctatagtcccagctactcgggaggccaaggcagaaggattgcttgagcccaggagttcagcactgtagtaagctatgattgcaccactgcactccatcctgagttacaaagcaagaatccatctcaaaaaatgaaaattatagatataaatgtgaaacctaaaactataaaatatctataagaaaacatgaaaaaccattcatgaccttatgttagaaaaggtttcttatacacgacagcaaaacacgatcagtagaagaaaaaatgactgtgttggacttcatcaaaattaaaaacacttgctctgtaatgagaatggaaaagaaaaggcacagattggaagaatttctatataatttacctataattggggtagatgagaaattcttaaaaaataataacaatgcagtttttaaaatgagcaaaatgaaaagccatttcttttagtcatttttaatttttgtggtttatgtgtttacaggatacatgacccaataagtgtatagtggtatcttattgtggtataaatgttcactttcctaatgattactgatattgagcatctcctatacctatctgccaaccatacatcttctttgataaaatgactattcaaaacatgcttgttcaaaatattgatgaacactcatttcatcaaagaagatataaggattgcagataagtacaggagaagatgctcaatatgattaatcattaggaaaacaaaaatttataccacaataagataacactatgcacttattagtatggataaaattataaagcctggtcatatcaaatgttgggaagaatgttgaggaacaaatattctcacgtactgttgatgagaatataaaatgctataaccattttggaaaatagtttgatagtttcttaaaaagttaaacatatacccaccatgtggtgcagccattctactcctaagtatttaaggaataatgttcaaaatgatgttatttgtaatagctcaaacgccaaaaaacctaaatattcaccaacaggtgaaagaatacacaaactgtgatatattcatgtaatggaatattactcatctacataaaggaatgaccaattaatacacccaacaacacagcaaaaatcaaaataattatgagtctaagtagccagaaaagccaaggcaggaggatcacttgaggccaggagctcgagatcaacctgggtaacatagggagaccccgactctacaaaaaaatagaaacattggccaggtgtgacagcgcatacctatagtcctaggtgcttgggggtctgaggcaggaggatcgcttaagcctgcagtgagctaggattgcaccactgcactccagccaggataaaggagttagatcctgccaaaaaaaaaaaaaaaaaaaagtacatactgtgtgattcaatctctatgaaactttagaaaatgcaaagtaatctagagtgacagaaagcaaatcagtggttgcctggggatgggaatggggagtgatggattacaaaagtgcgggaggaacgtcgtggaggtgatggatatgttaagtatcttgacttttgtgtggtttcatgagagtatacatgtgtgaaaacttatcaaagtgttcagtttcaatatgtgcagtttattctatgtcaatagtactttaataaacctgttcagaaatgtataaggacaaatatctatttgtccttttatacatatatatctataaaacataaaataatcctctttcagacttatttctcaggcttcaaagaattctagcaaataaccaagtcccttatctctcatatcttttgtgattttgatgtctgtaaccaaatggaaatttactttacaaagggatgtttttctcctcctgcttttaatccctaagcttatcccttttgagctgctcagtgattcattctctcccagtctctcagatgactcaggtaagccatgctgtgaaatgaacaggagtgagagctttggagtgatcacttatgttaaattcagctccaccattcactcactctgtaaccgggggccagttacttagccctgccttcttcatttatacaactcagacaataattatattttagagtcatgatggggataaaatggcatgatataggtaaagatcctatgaaaggatctcaagaaatgttatattaaaactttacacttacaatcgattgtgctttagaaaatatttgcatttaggttgttgtggaaaagaaatacaatatgtggtattagtaaatatatatcccaataatatctaggctaggaatgatgatttacagcatattactagaatataacatttaatataaaaacaaaaaacagatgtttcctctgcctattcataaccttattcttcatatgcatgtaggtgttttggtacggtatacctgttttataacaggtgccattctctaagatattataaaaagctaactttaatttcaattttatggctgagtgtcagatgctatatatgagtttgcccacatcaccatgacaactatgtgggaaggtttttgccacagccctcatggttggcctagtgttttgacatttcagtaattgccagtgtcactacctttaaaaattacagagaactgacacctagtccagatggctactaaataaagaaaccgctgtccccacagctgtgacatggtactgaagacaggagagccttctatcaaagatatggtcactaagaaatgatgtgaaagatcttgacttataaaatataataaatggccgggcacggtggctcatgcctgtaatcccagcactttgggaggccgaggtgggcaaatcacctgaggtcacgagttcgagaccagcctgaccaacatggagaaaccccgtctctactaaaaatacaaaattagccagtcatggtggtgcatgcctgtaatactagacacttgggaggctgaggcaggagaatggcttaaacccgcgaggcagaggttgcagtgagccaagatcgcaccattgcactccagcctgggcaacaagaatgaaactccatcacaatatgtgtgtgtgtgtgtgtgtgtgtgtgtgtattacattagtaaattattattaagccctttgcaacattgggcaaccctggagtggaatacaaggaaaatatatgatctagtacttaacttcagggtctctacattctgctaaggaataaaagatatactaaaagattaaaactagaagagtcatttatcccttcagcaaatacttattgaataactactatgtatcagtaggcattttagatactggagttacagaagtaaacaaaacagacaaaaattcttgccttcgtggaacatacattcctgttaggggagacagagtaaaacaaaatagataagtgaaatatatactatattagatggtgataattgctggaagaaaaataaagcagggagataggatttagaatgttggggagggtgaccttactgaagagagaaactttgtataaagcccagaaagtgaggaaggtgtgacccaagtcgttaagggagaagatgatttcaggagaaggaaatcacaggaataaagcctggagaggtgtgggaactgtcataggtaaggaaacagatgggagaccaaagtggctggagcaaagtaagttggggaaacaagtagaagataatgtcaaagaggtcacagaaggtgagatcttggaaagctgtgtgggccactgtgctgactttggcttttactcaattgagacatgaagccactagaggacttagacaaagacaggacttgaactggccttttttgtagcagataacattgactgccatggagctgtaagcagattgtctgattatcaaacatcactggaatgtgtgagtcaaagagtaagtcatggaagtctgtggacaggagaaatcagttcaggtcagagtatccaagggcaattggaggagacagcatgggtatcctgtgggtaagcgagtgtggtatgggtaagtggccaagtagagagaatagcctgaggaaatagggaagtggagctggagtagaagagtccatcatgaagaggttttctatttgtccgtgatcaataaagaaggcattctaattcccaaaaccctctacctctggagggggtctcagaatttgcctgccatgttcacagacagaaatggattaggaagattaaaacaaggagagaagacactatacataggtagaaataaagtgggataggtaaggtgcagctgactatagatatgtatggcgcatagctgacatatttgagctagagaatgaataccaatgcaaagttgttgggtattactgagcatagccctgccatggaattctactaaagaaggtctggttatttgaaggaattttatgttaaaagaattttgccgctaccaatagacccagggcaaatgccttttcagggtccttcttccagaacaataaccatcagatccagatatcaaattccttcaggtgctgaagctttggtatggcaaagataggctagatgttcagcaaatccatttccttttcctgagcacataggaaagcaccatttacaaacctactttgcagtacctgactagaattagttgatagaatatgagctaaagtgatgtgtgctacttagaggcctgcgttctaaaaattcacaaaagatcctggtctcaatctccctcctacattcatgtgactagaaaaaaagggatccaaagatggcaaaatcatgtgttagaaagagcttggctctctgagtcacttaaaagactcaggagcacttcacaatctacattagattgtgatataagcaagaaataaacttttattgtattaagctactggttatttgagtctgttgtcatagcagctactgttaattaccctgacttgatatacctttctcctgctcctgatggacagcagcagggctttgtcatgatatgtaaatgccaatctacaccaaagtgactacaagagttaaaggatccatctgttaccatagtgattcccactgaccctgccaattcaatttattttggaatagatccaggatatttgagctgttgcttggaaaacattttactgatcagctcaagggttcatgactatcagagcagatattaaatataacctaaatggcacatgatttctttccaatgaagtattgatacaaattcaaggcatgagttaaatttctttcatatcttctttatcaaattatcacttcttacatccattaagcaagattctgaactggttttaagagttacaagagaggaggccaagaatagttagcggttaatctcttccatcaggtattttataatttatctgggaataccttcaatacaaggttacacatgataagtagaaaatagttgaaatgtgacttaagggctctaggcattagagaagtagagaatgcatgcatctggggaaattagggattaatgacatagctagtctttgagttgaatcctgaagtttagttgggctgtgagacagggagttggaggcagagtatttcaagcttaaacagtttggcaaactgaataatggagttgagaaaatacatgtcctactcagtgtcatagattgtaacaaataaggctgggaatgcaagtttgaaaagatgtttttaaccatgcatgccaaaccatgatttggggaattttcttctatatcttaattgttgaagaattttgaagaaaacgaggtaatcaaaaaccatatttaaaaatattaatctgacagtataattcagaatttgttgggtgagggagagattacctttattttattaagctgctgggaatttgagggtgtcacagaagttattgttaggtgacagaagaatgaggtaaacttggtgatcctctgcagggctgaaggaaagggagaagacaagggtgacttaaaagattcaattttaggtgattgagaaaattttgcaagtagagaaatagggaaaggggtgagattgaggtacagaagatgagttctgcttaaaatatttcaaatttgaaatatgcacatgtggctgttgtacagccaattaggaggagtatatctgacatcttaatgacatgcagtggtaatgaagaatccctggtgcaaaattactaagagtgaatagaaggctagaaactatccctaatgtgcatctttcagatagtaactgcaggaaaagctgggtccatcagacctaaaaaatgtgccacaaagaaattatagggtaaactcatgtatctcatattaataaatgtgataatgtgattaaattgattgatttgtgagtggtgggtttatggaaatgaaaagttatgcacactgaagacatcacagtaaagtggttttgtacaagctttggcatttgacaggctagatttatatcctggctctgccacttaatagctctatgacactggacaaattgcttaaactctctttcttcactttcttcagttgtaaatttgggataatattaaatgcctagcagatagagatattatgagaagaacatggaatagtacctatgaagcatttaacatagtgttaagtcagcttgggctgccataagaaaataacattgacacagtggcttaaacaaattttttttttcacagcgctggaggctggaagccggagatcaggatgtgaacatagttgggttctggtgaaggctcattttccagcctacagacagcctccttcttgctatgtccacacttggcagaaagggagagaaattcagggcatgaatcaaattttttttgtatcttctttatcaagtcactggtatctcttctcttaaggacattaaccctatcatgaacaggctaccctcattagcttatctaaacctaattacttcccaaaacttcatctccaaataccatcacactaggaattagagtttcttcaacatattgagggtatttgaggggacgtaatttagtccataacacacagtctctggcatttaataaaactcaataaattacaacaatattaggaatatttcttctgcactttttttctagcaatttcacagagccaagaatcacaacacttccgaacacataaaagaatgtaaatctaagaaagaattcaaccaaaaattacattgtttggagaaatgaaactcaaataaatgcaagtcagaaatctctatgagtcacagtggagaggtttgtgcatttataaactaagtgcaaactcttattgccagaaggtttccgattagactgttttatatattctgctttaattgccacgttttacatctgtgaaattctagcaaaatataaaagcaacgtttaagaatgttttatggtctaaaacctcttatctatactatagctatgtaatccatggcattatacaaagctgtgtgtagcagtagtgcttctctgccattttctatctctgtaaccttgggcaagttgttaaatctctctatatttggtgtaacctgtaaaggctgctctcaatttacaaaatttttggaaatactggccaagaagtatgtctgtgaaagtttagtgtgaggtaatctggtaaaaaaaaaataagctagtcacttaagacctgctctatatgtgtgacatttcttagagctcactgcctgttgcctctgaattctacctggaatttttgtgttttgcctagactgtggcacgggagaaatcattatagctttctcctttgaccaaagctacaaattatctcttcttttctaggaagagtttggatttgtgttgttgctgtttgtctgatttttttgttgcttttattttcatttctttttcaactcttattttagaattggggctatatgcacacatttgttacaaaggtttattacatgatgttgtggtttggggtatggttagacccatcacccaggtagtgagcacagtagccaacaggtagttcttcagcccttgcccccctccctttctctccaattaaacattccctctaggttacaacatcttaagagtaagttgcatggcctattcatgcccacaattctataggataatgccggtacgatgctagtgcttaataatttttaaatatgaaggtcaaattgtgacccctggagaagaaaatccaccaaatacttcttttctaaggatttttccttagaaaaaattactctttgtataataatttggctagattccaggatacttactgggccacctgtgatagagtgcagaggtactatggattcaaagtcagggacacgggtatagccttttctctctttcctcatacactcttgctatggaaataagttgaagtggggcacattcttatctggaggcaagcctggccattttgttccctgttctctgagtgaggtagaaatcctggctctctggaacttcggcacccttgagttctttaacctgttccctgtagagctgccaaatcttactattgtaagatgtgcatctgaggctgaggaataggtccccttgatgtaaaatttaggtttatttcattccaaatgaccatgttttgaataataaggcattttaatttcacatatgaggtacagtcattgtttggtaagactgtatcacataagtaaacctcatgcagaacagtggctatagttttatagaattctgtattcctagatcccctagcaataacaccatcttagttgtatcaaaatcttacctctgtctctagcacagaggaaaattaagtctgaaacatagtaaataacttcaaagggggattttttaaaaatcctgaataggtattattgaacatcacatggaaaaatttagaaagcaaaacatatgttttaattgattgtctaagaagcacatagcaaattttctgcaataagggttcccttgatgcctgaatttttaaatttttattctttacagacagggtcttgctctgtcgcccaggctggagtgcagtggtgccatcatagctcactgcaacctcaaactgctgggctcaagagatcctcccgtcttggtcccccaaagcactgggattagaggcataagcaaccatacccagcctgaaatttttagtttcttgtttcagtttccctcttgtcattgttccttcctcccatatttatcattctctttggagtacatacatgagtacgtccataaggcatggccccgggttttctcttatcctctcaggcaatatttaattaagtttattcagcagacaagaaaaggaagaaaattcatctggtgattctttctctacacagaattactagattcaaatagtcacagataatgggaaggtattctcccttgtgaaatcaggttccagggtgcaaggcctatgctattccagatcaggagaagccagtagtgaactgaatttgatgtttgcattttctttaataatttggctcaggaaaacttttggtccatggttctactttgatataaagttgaataatgtaattctcttggactataggccttcatacaagcccatcaaacactgaatagagccaagccactaattattatgaaaatcaatagttgaattggaacttaaataattagtaaatatgtatccagttgactgtaggttgcttttccaaacaacattttgactcatgacagagattttgttgcaatcactaaaaaccaattttagtttgacttttttaggataaataaatgaagtaaatagtattaatttaaaggatattgcccacccccaccacctggatgtactagtagctaaaagaccaagtttggaaagttggcccaggtccaaaggattccaggcagcaggaaactctgcttttagcaatttggccagagtatgactacatttgcaccctatcatgaacttgattgcaaataaatactgatcattcttttgctgtacttagctttctccagattcctggaatacagctgccaatttactgagcctgggttacattcccattgcttggcagtcaagtaaaaggaatacaggagaataaaagctacttcaatttcccaaatgaaagaataatagttttccataatctaggtaaaataaggggtccatcaaaattagaaaagcaatttgtattctatgcagcccaatcatgaagatttctatagcttaatttgataattgaggacaatataagtggtctctggccgggcacggtggctcacacctgtaatgccagcactttgggaggctgaggcgggcgggtcacctgaggtcaggagttcaagaccagactgtccaacatagtctctactaaatatacaaaaaatacaaaaaattacaaaatacaaaaatacaaaaaaatactaaaaatacaaaaaattagccgggcatggtggtgggcagctataatcccagctactcggaaggctgaggcaggagaatcgcttgaacctgggaggcagaggttgcagtaagctgagattgtgccattgcactccatactgggcgacaagagtgaaactctgtctcaaaaaaataaaaaataaaaaataagtgatcttattaccatcatcattatcataattaacacttaacaagcagttgcttgctaggctctattcttacccacactttccctatactatctcattttatgctcccatcaaattttatgacataattactattagtgtccttttaacaaaaatccaataatgtttagacagagtaaataacttgcccgggattacacaactagtaagtggcaaaatagtttcaaacctaggttatatgactccaaataagctaaaccatatgcatacgcatgagactaattcctctactgcaattttacggattttaggacacactagattcttaacaaatatttactgaaatctctgttaactagaacaccctggcacacagttggtgctcaatacatactcgttgtataaatacatgcatatatatcatgttttgattaaaagatcagatgtcagaaggcaggtgtctgccgcccccaccccttcctcgtagctccctccagcatgcagctcctgagctatgtgctgagctgggtgatcccataaatcaaaggaattgaagtctgggttataatgaaataaatgtgtattcatagtggtaaggtggatagtgtatttaagcagtttcttatctttgttacttctttctaaacatgataataatttagaaaatgttcgttttaggtatactgcagatagcatagttgaaagagtcagattgaactgggtttgaaattctccccaagtatgttttagctttatgtcatttagcattttattctaactcttggatctcatctaagcaagggcagaaaatgatgcttagcttatgtgtttgctgtgagggctacatgaggtcataagtgtgtaaagcatctagaatgtagcacctgtggtgctactttcctctcctatctcttctttaatggctacctttgaaatatttcagaataaaatggcttatagaaaataattattgccatggttgaaataatgttgtgattttaaaggaatatctatgtcctacaaaatttgcaccattggtacaatagccactacactcagaagagggagcttcataaatactttttgataaaaatgattcaatattaatcattttatatagatctactttctaccctaatcaaatctcttgtattagagatgatgattaatctctcatgtgtgcaatatgtgaactctgcattttctggttcaattctttgtaggtttacatactgcaatgtaattcgtttttgcaattttctacttcatttcaattacagtgcttattataagagatggaatcttcatttagcatgctcattatttttaattagaaataaaatcttgaacgaacttaaattttttgcatctcttattgtcagaagcataaactctagaacactgtgtgaataaataagcacagtaattctcaaattttcaaagatggaaagtgttaattatgtaaatatactaatagtgatcttgtgtatgtaaattgtactagatgtacaataacaattagcaagtttctaattatttggtacctgttgtggggtcataacttccatatgtattatctctaattctcacaactctaaaagaaagtattatttttctccttttcaaagtgagggagccctgaaaaaagaatcattttcaattctacctgggaaaggctatcaaggattcatcgtagagtgaccactagattgtgttttaacgtatgataagaagctaattggacaaaaatgagaaagccacatcttcaggaaacattataaaacacagttaaaatataactcattgaaaagaatggtggcgatgaagataaacagacagggccaagtgggaaaagtctggtctaggagtttgatcttagtatagtaagaagactctaatgctatggtttttgccacacaatcttttaaataatatcataaccattagccctcatgtccctgtggaattctttcatttacacaccatatggaagttctgcaaaatactgtaatgtgaatgagagatatggtatctaaaataatatatccatcagagggctgccaactggctgttcatggtgaatcatttaaatttaaaatttgatgttctgcacggagaagtgtgcaatccctgttgaatttttgaagctccctgaagaagcctcttctttctgcagctgctgtgttcatttgcatttcaatatgagcattcagaggtcaactgcctgtatttcaggcacaaaataaactggagacactgcaaatattatgaactggtgtctctacaggcatgtggatacagctctgggtttccagtattgccatgctgcctgacaaagaataggcagtatagtgttaggcataggatgaatgatttatgtgatgtcatcagttactccacccttttcatagactatttgttttcttccctacaacaccagtcactgcccaagccctaaatcaatagctagtcatttgttttattaaacttgatctatgttcccaaaaagctacctgcaccttcattacaacattcatttctctgttgggcccactttatgttagattccatacagtaagtctattccaccttcaaccatcataagtatgatccactggtatattcctgacaatgtcgagcagtgttctgggtgctggaaatacaatgataaacaagatcaatgtgtgtctgatccacatagtgctgattttctactctgaagtaatctctgaatcccatgatatgtttagaggcttttgcacagaataggcatttagcaaatgcaaaatgaagaaatggattgcctagtctaagccatggtgttagaaactatggaagatccaagataaacatgacaaatgttagccttcagggagttcctactctgtggtgggcatagacaagcacatagataattctaatgcatgacagaaagtattgtgtgttgtaatagagatataaacacatttctgtgggagcatataatggcaaaagattaattctggcttggagggagggatgttctgcccttctgtcacagcagaaaaaatatggtatcatccactgtgcataactgaaatccatttgccatatgcataaagaatgagtagattcacaaaataaatgacagtagggagaatttgattcactgcagttttttttttcattgcaatgttatagtatgttatccagtggtgttttccagatgtataatcatcttccaagaaaatacttggatcccttcccttatatcttccttccttttactatcctttccttactaatgggtacagaagaaacagtgaggacaatctgaaagtattttagtacctagaataagaactaacacaaagatttaactccagattttttaaaaataaactgctgcttgttttattattgtatggtcatgagttaatttgccaaatcattcttaaacagtggttccttagcctcacataatgaaaataacactacccaagaaattaggaggcaagtattctgaggctagctgctactaactagaggtatgactttagggaagtcctcttggtcttattttccttatctttaaaattagtttattggacaaaattagaaggtcacaatcttggatgagacagggtccagagcatttgccatgtgagaatatggagccagtgttgtcacatcttctgaattatcaagagaatccacaaagcttgatattaatgtgagatttccataaaacggcatttaggccaaataaaacatatctaaaggccaaattcagcccaagggcttcctttcttcagcttgtaaagtagatgctctctgaaatctcttgcatctcagacattctttgattctgcactgttaagacagtctgattttcctttgtttaacagctacttcaaagttccagtttccctgatgaattaaagaacatgttttgagcggctgtaaagttaaattataatcacagattggagagttgtagtttctgctaatccttttggaggcttctgatttgtttaaacaatatgaaaattaggagtgaatgttaagtggtctaactcaaggatgtagttttgaataaagaaaaaaagaaggaaaagcagccctttcctgcttccatttcctctctacatgctgctgtgaggcagatccagccagagagcacctggcaagtcaagtcggcttagtacagaacctcatggctaggttaatcctggctcatagcagaccctaaaaaataatcgttgaacaaagtaaatactactgaatgaagtcctgttctttggtgcactatcatgccaactaattaacatgcctaccatttactggataagaaaagaactttgaataaaacaaaccattttattatgcgcacttaagactttaaagtttgcctaagaagatgaaactcctttggtccccacaagcttctaccactgagcccatacttatatgttgaatcgtttttttttttttgaggacacagattcatcttacttatgtttctgtcagcagcatccagcacagtgtctgacatgcagtaagtactcaataaatgtctttttaatcagtgacttaatctctgaatgagtcaactaataaattatttaatgagccagagtttctctctagggccaaagcagcaagaaaaaagaattgaatataactcagtgaattctactaaatcatttaaagaaagatggtatcaacagtctgagtttaaaaatgaagcaagaagattagtaaaagtttctgggctctttacatcacttccaaataattgtatacagttgccatattctggacatttcaaatataatgttatgcaatcttgggtgctgtttaaatctaatggagaatattgatttttttttaagtataggcaaacaacctggttagtttagtctgtaagttcccacttaccttcttaggctgcgcctccaactgtcagttttcaaagcctttgcagtgctatcaaagtttatcaaacatatgcctcattgagtggtcagtctttagccctgggcattgttccatcccatagttgagttctcaaaagttggtatgctgaccagagtcaaatcaatgcctgtacaacttagggggaaactaagagttcatactcaatgctataggactactttcttagcactccccacctcactgccctactgtctccctgtcccactccaggttccagcctctcccacccacctcctggtcttctggctagaaatctgagactttagttttcacctctgcctctcactttctgtccctgagatcaccctgccatgggaaccaagtggggaaaggctagagaaaggaacaaaccaacagagaattttcccccgcacactgttgggatacagttcctttggtcacagagaagggtttccatccttagagttataagcatccacccagacactgttgcctttgcacccaccgcttactatcatcaccttgccagggttacctgggggcttaactagaagaaaagaaaaaacaaaaatagaattttctccatgctctctgatttgtagggtgtcattttcttttcctcagactggaaataaacttctgttggagctttttctgcttacatctggtgcacagttccacgatttggctgcttttgagtctaaatctgaagatattggggaaaaaggtccaagaaactcatgcatgattcagtgatgttttgagttctgttatttttccccaattcacttattactacttatttttcagagttctcaactagcttctccagctctgtccaggatttttagctgtattcagtgggagaatcagagtgtgcttactccatcttgattggaccaaaatttttcccatgtagttttattagatggtaaaaatacacaagattgcttaatggggttgtctggcccacctaacagatcctgctgtaaattggcattgctatgtttagttttgtttaaacaagtgctgttctacaaaggaatgctttctgtctggtaaactgacttgacaatctgagaatgagacctgttatttgatcacactccttgaggcaccctgtcatacctttggcctcattcatgtgcttaacatatattaatagagccaattgtgtgtcaggtgctatgctagatacaagggctacatctgtgaggaacacagaatccttgtctctagggagcccacagtgtcctggaaatcagtgacagatcaccgccaatgttacaagacagcaaaactgagccttagatccaggttagagatagttatgtaaacaggcaatttttgtattgaatgtttaatatatgataaaaatcagtactagtattataggaaaacagaacagaaacataattatgtattagtgatttctcacttctcaattaatgacactctaatccgtctacttacttaactgaatacttggactcatccttcattcttcatttttcctaacactccacatcctatccattagtacattctattctctatgctttcaaaatatattcagaatcctaccccggactaagctaccataatctctcagcattctgtcacagtatttcctgtgtttccccctttttccactgttgttctattttccatgcagcaaagtaaaaaatttttaatgaaaatcagattgtaatgtttctctggtaaaaaaaaaaaaaaaaaaaaaaacactccaaagccctatcttatccaacccccatctctcttgcctcatatcctatttctcttccccttgttatgtttcagcatttcttttattcctcaaagaacatattaggcatatttgcacttgctaatgcctctggcaacaaacttctcccagatctttatattttgaatgtgaagaaatcatattattattaacaaaacttgggtcagggaccaggtaccataaatcaatttattttatcaaatgctttgttagtattaacttgtttaagtatcatctcagtctgctagatactatttttaaaaccattttttttcaggcacagaaaggttaactaacttgctagtaacaatgaacagcaagaaaatggcagaactgtgattataaccttctgtctacttccagaatctgtgctcttatatgctctgctctgctgctcttaatagttgagaggcattctctacacaaagtgcgatgtcatcttgcatattcacccccttcagccatgtgtggagttatggagggagtgaagatagatggggacctaaacctggagagataagaggcaagaaaattccccaatttaccaatatattcaccacatctataatattgagactaacgtattaacaaatgtctcttataaatgtggataccaaccacatctggccccaatttaaaaaaaaagctaagcttgccagctattcacagtaactttgatttttttttttttttttttagtctcttaatctatagtggaaatagcccctagctgattgggttttatgagattaaagcattttgtaaagtcctgattttgttagcacacatttcaatggagctgtctcagctacctgaagaaggtgaaaggtcagccatgtgcttccttctctggtggaggaagaaggctggaaagtaggtgaaatggcacaggcagaatttaaacttggatttctatgacttgaagtcctgatgcctcatgaatgctgaaacaaatcatgatgtctttctgtaaaatacataagcatcaaaatgacttaataagaaattacaaaagttaaacttctatttgttctcttctggtattttgttggttttccaattattattatttttattattatcattttgagggggaggagtttgcaatcacttgggtctctgggtgattaggaaaaatagtcaccaggcacttctacaagatcctaatgctgctcaaataggccagttgttcccagatgctcaataataacaaaagatttaatgaactgtgaacaaacatgtacatccgtcagcttttaagatcttgttttgatcggccccttctgtacatacctgggcccaggtcttgggcagtgctagcaggcattatctaagagaacagacacatggaactgtgtaggaaaaattcaatatcgttgccatttgttttccctaagtttatctcttatttagaataatttttaaaaaggtgatacagggatttcttctttccaatgaatagcaatatagtgtaacaagaaaactagtcatgacattacaagtttctgtctacttttgatttttaccgcctgagtgaccacggaaaatcgacttcacttgtctacagcttagtttctttatatatacagtgtggatagtttctgctgtgcaggtctatcttgtagtgcttaggcacatatcagatacatgcaaaattatgttgaaaagtgctaagcaaatgcaaattgtcaatattgtccccattcaatgcaataaacagtgtagtaagcatgccctacacactgtgatttaatttacaaattaaaaaggctcaaaattgcctttgcaccagttgctgtctattgtggaccaggcataaatcaaaatcagaaaaaaaagctaaatagtgactgcctgagagtctaatgggcatcccatcaggtgagacctttcacttacttttatactctaaagtcttgaccagaaatatatagtgactaaaggttattatgatttacattttgacacagttactacttaggaagcatcttgtgccaggctctgtgtgatgtacctatgacttttctataacatttaattctcatattatccttgtaaaagaagggtcatcatttagcagatgattaaactgaatgttaagtaattgaagtaacctgtccaagccacagagccaggaagacacataacaggattcaaacatagatctccataccctgttcaaaagagagaaaaataaaagaatgagactcaaacccaccttttataacagccagaaaaacatgtactgctgaactctgatagtggttgggaggcagagttgcagaacatggcttagggtcaaggtaaagcacataagtgtggcctcagagattgtcactgaatacccaatcttctggatcgtgtgagtaacctcttctttacttagcatgttaaatagggaaaggtaggttataagactgacctgggaaatggatgtttcaaactctgctcccctgaagtattcccacaattctataataaggtatatagagtgtcagagagaggtctagagaaaatgatccagagttcaaagtgcaacttaattttaatatctgcaatcatggtggtcttcatgaaggaagtgttcttggatcctttaaaaatggttagcagctaatagcacaataacaggatcaaattctcacatatcaatttatatcctgagtgtaaatgggctaatgtccccacttaaaaggcataaaatggcaagttggataaagaagcaagacccaactgtctgctaacttcaggagacctatctcacaagtaacagcacccacagtctaaaactaaagacatggagaaagatctatcaggcaaatggaaaacaaaaaactgcaggggtagcttttcttataaaccaacgataattttttaaaagacaaagaagagcattgtataatggtaaaagttacaatacaaacaagaagactcaactatcctaaatgtatatgtatccaacattggagcacccagattcataaaacaggtttctagagatctatgaagagatttaggaagctacacaataatcttggggaacttcaacacctgactgacaatgtcagacgtatcatcagggcataaaactaatgaagatattctggacttaaactcaagacttgaccaattggagctaattacacatctacagaacaatccatccaaaaacaacagaatatacattcttctcgtctgcacatggcacataattctaagatgagcacgtgctcaggaataaagcaagtccaagcaaattcaaagaaattgacatcatacccaacacaccctcagaccacagcacaatacaaattaaaaatcattactaagaaaatctatcaaaaccgtacagttacatggaaattaaacaatgtgctcctgaatgactttgggataaaaaaatgaaattaaagcagaaatcaaaaaattctttgagtgcttgctttggcagcacatatactaaaattggaacgatacagagaagattagcatggcccctgcgcaaggatgacacgcaaatttgtgaagcgttccatatttttaaaagtgggcgaaggacatgaacagacacttctcaaaagaagacatttatgcagccaaaaaacacatgaagaaatgctcaccatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggagtgtaaactagttcaaccattgtggaagtcagtgtggctactcctcagggatctagaactagaaataccatttgacccagccatcccattactgggtatatacccaaagggctataaatcatgctgctataaagacacatgcacatgtatgtttattgcggcattattcacaatagcaaagacttggaaccaacccaaatgtccaacaatgatagactggattaagaaaatgtggcacatatacaccatggaatactatgcagccataaaaaatgatgggttcatgtcctttgtagggacatggatgaaattggaaatcatcattctcagtaaactatcgcaggaacaaaaaaccaaacaccacatattctcactcataggtgggaattgaacaaagagatcacatggacacaggaaggggaatatcacactctggggactgtggtgggatggggggaggggggagggatagcatcgggagatatacctaatgctagatgacgagttagtgggtgcagtgcaccagcatggcacatgtatacatatgtaactaacctgcacaatgtgcacatgtaccctaaaacttaaagtataataaaaaaaaataataaataaataaataaataaattctttgaaactaatgaaaacaaaggcataacataccaaaatctgtgggacatagctaaagcagtgttaggaggaaagtttatagcactaaatgcctacatcaaaaagttggaatcatctcaaattaacaacctaacatcacacccaggaaaggaagaagaactagaaaaacaaaagccaaacaacatcaaagctagcagaagataagaaataatcaaaatcagaactgaaatgattgaaattgagatgtgaaaatccatacaaaacatcaatgaaaacaaaagttggttttttgaaagattaaacaatattgataggctgctagctaggttaataaagaaagaaagagaagatccaaataaacacaattagaaatgacaaagggacattacaactgaccccacggacatacaaaatatcctcagagactattgtcagcatcactgtgcacacaaacaagaaaacctaggagaaataggtaaatttctgaaaacacccagcctctcaaaattgaaccaggaagaaataaaaattctgaacagataaataacaaattgtgaaattgaatcagaaataaaaagcctaccagccaaaaaatgtcctgggcccaatagaatcaaagccaaattctaccagatgttcaaagaagagctagtatcagtcctattaaaattattccaaaaatacaaggagaaggtactcctccctaactcattctacaaagccagcatcatcctgatatcaaagcctggcagagacacaacaataaaagaaaacaacaggctcatatccctgatgaacatagatgcaaaaatcctcaaaaaatactagcaaacagaattcagaagcacatgaaaatgttaattaaccaccatcaagtaggccttattcctgggattcatggttggtttaacatacgcaaatcaataaatgtgatttaccacatcaacagaagtaacaaaaaccaagtgatcatctcaatagatgcagaaaaagccttccataaaattcaatatcccttcatgttaaaaactctgaacaagttaggcaacaaatgaacatacatcaaaataataagagccatctatgacaaatccacagccaacatcatactgaacaggcaaaagctggaagcattccttctgagaattggaacaagacaagaatatccactatcttcatttgtattcaatgtagtgctggaagtcctagccagagcaatcaggcaagagacagaaataaagggcacccaaataggaagagaggaagtcaagctacttctttttgcagacgatatgaatctataccaagaaaaccccatagattgcaccagaaggcttctagaactgataaacaacttcggtaaagtttcaggatacaaaatcaatgtacaaatatcagtagcatttttataaaccaataatgtccaagctcagagcaaaatcaagaacacaatctcatttacaatagccaaaaataataataaggaataactaggaatacagtttaccaaggaagtgaaaaatctctgtaagaattacagaacactgctgaaagaaatcagagatgacacaaacaattggaagaacattctatgcccatggtcaggaagaatcaatattgttaaaatggccatatcactcaaagtaatttacagatacattgctatttctaccaaactaccaatttcatttttcacagaattagaaatgtgcatcctaaaatttatacagaatcaaaaagatctcaaatcaagcaaaaagaacaaagccagaggcatcacactacccaacttcaaactatactaccaggctacagcaacccaaacagcatggtactggtagaaaaacaaacacataggccagtgaaacagaatatagaacccagaaacaaagccacacatttacactcaactgatcttcaacaaagtcagtaataacaaacagtggggaaaggacttcctatccaataaatggtgctgggatcactggctagctgtatgcagaagattgaaattggactcctaccattcactatatgcaaaaattaactcaaaatggattaaagacttaaatgtaagagctaaaactataaaaaccctagaagaaatcctaagaaataccattctgaacattagccttagcaaagaatttatgactaaattccccaaagcaattgcaacaaaaacaaaaattgacgcatagaacctaattaagcaaagggcttctgcacagcaagggaaactatcagcagagtaaacagacaacctacagaattggggaaaatatttctaaactatgtatccaacaaatgtctaatatccagaatgtgtaaagaacttaaccaaatcagcaggcaaaaaacaaccccatttaaaatgggcaaataatatgaacagacatgaatcccactactgagtgtatacccaagagaaaagcactcattctacgaaaaagacacatccctttatatgttcatcacagtgctgttcacaatagcaaatacatgtaatcaaccaagatgcccatcagtggtggactggttaaagacatggtacatatgcatgcatggtaccatgcaccatggtacatatacaccatgaaatactaaacagccaaacaaaatcatgtcctttgctgcaacatagatcaagcccaaaaccattatcctgagtgaactaatgcaggaatagaaaaccaaaaactacatgttctcatttataagtgggcgctaaacattgaatacacatggacataaatatggaaataacagacactggagattgcttgaagaggaagggtggtagggagctatggtttggaaggctacctatcaggaactatggtcactatcttggtgacaggatcatttatacaccaatcctcagcaacacaatttacccatgtaacaaacctgcacatatacccctgagcctaaataaaagtaagaggaagaaaatggttaggactagtattagtgtaggattagggagaaaaagtaaaatagaagggtagtctagagaagacagtttgttaatttaattcattcaccaaatatttattggtggccaactgtgtgccagaaattgttctaggcactgagtagaaaacaaaaaagaaaatatccgggctcggcacggtggctcacgcctgtaatcccagcactttgggaggccaagtgggggccaatcacgaggtcaggagatcgagaccatcctggctaacatggtgaaaccccgtctctactaaaaatacaaaaaaatgtacccgggcatggtggcaggttcctgtagtcccagctactcgggaggctgagacaggagaacagtgtgaacccaggagatggagcttgcagtgagccaagatcgcgccactgcactccagcctggaccacagagtgagactctgtctcaaaaaaaaaaaaaaaaaaaaaatccctgttttcatagagcttatattttagtgagtggtgtttgagacagccaataagcaagataataagataaatttataaaatatgttaggtgttggtaaagtgaaaataatgtcacaaaagaagatagggagtgttggtggggggaggtagagatgcaatttagacaggatatccagagaaggtctcacagagaggattatgcctgagtaaagtcataaattgggaaggaaacatgccctgcaacttgtgaagcaagctcaccatgcactggttaccaacttgtgtgacagaacatactcatatgcaagttatgggaaatgggtttattacttacagataggcagcaaaaaacatcagaagcctaggactcattgtgagctgctcccccaaagctcagaaatctgcctagggtggatggagtctcaattgcatgtaacccacttgcatagcagataagggaccctggaaagcagcctgccctgggtgttatatcctggggtcacatgacttactgtgctaaatcattgaaggacatgctgttctggtgagactgaaacagagcctaggctcttctagccagtctctatctcagtaagttacattatcagaccatcatacagttactgttgagaactacaagcaagaaagggagaaaaacctggtcagtccaaggccatctggagaattgtcctgcacaaatcttgtgggcagaacattctaggcagaagacacagcaattacaagggctcagaggcaggggcatgcctagcatgtttgaagatgtgggagaaagtcagtgtgtctagggcggaataatttacgagaagagtattaagagattgagtcaaaggaataaggggtgaaataccatgaggcacgctcctgtatgtctttgaaggccattgcaaggactttggcttttacttttagtaatgagaaaaaagtcactgggaagtttgatcagaggattgtcatgatctgacttctagttaaggctattgtgctaaaaacaggctagagtgcagggaagatgggcaaaaggagaaagcaggcaaccagttagaagactattgctgtaatctagacaggagaggatatatactgagtctggtagaagtagattagtgctaagtagtctaattccagataaattttgaagataaatcaaataagagttgtgaaggtatgaaggaaaaagaggagtcaaaagtgattcaaaagtgtttgacttggcaactagaataatggaatttccagcagtgtgaggtaaaatgtggaaatatgaatccagtctgtgtggggaaggaaattgtaagatttgcctagagtgtagcctgggaccactgtctagtcctgagatggaagcaggatttcccatcttatattatgtcacaatgcactacgccagtttctctagggagactctctactggggaaattaaaggtgtcagtatttgggccagcaatcaagatggagatgataagcctctacaatttgggaagccataaaacaacatactacctttggagagttgttgttgtttgttgttgttgaaaaaaaaaaaaaaaaacacctttcttaaagaaaacatttcttccaaaatgataagctctggctttacctcagctctttctttcacctattttttttttaaccacactcttcctatatgtcttaaccctattcattctataatcaccaggcctggaaatagatttcacttcctagacacctttgccataatcatggcctctaccacaggcaggaacattttcttctgtcattgggatcactgcattccctcttaatgagtttccctgacagtcctactcctacagccctttaaacctttctccacaatgtagccagattggtcttttctaaaacagaaatctgatcatgtccctccctagcctcaacacttcaatggatcccaaagctcttatcataaaatgcagtaatcttttttggttgtttgttttgtttgttttgaggctgactgactttccctcttgttgcccaggctggagtgcaatggcgccatcttggctcactgcaacctcccaggttaaagggattctcctgcctcagcctcctgagtagctgggattagaggcacctgccaccacacccagctaattttgtgtttttagtagagacagggtttcaccttgttggccaggctgttcttaaactcttgacctcaggtgatccactcgcctcagcctcctaaagtgttgggattacaggcgtgagccaccgctcctagccaaaaggcagcaatcttaacatggcttaagcatctctgccttcctctaccatttcagctctctcttttctcctacctcctactctctgtgctggtcattgatttccttaaagtctcccaaacatagcatgctctatcttatctgttattcttcaaaaatgcttggaccactctttctctcccttcatctgattgatacttagcttaatgctcagcttcagagagcttccaggtctgattcactattcagtcctgtctcagtacttatcaaaacacattataattgcctgcttagatagatgctcatctgcccttagactctaagtaaatgagagcaagaatcacttctttcttgttcagcatgatgtccctcactcggagcaagttctgagcagttagaaataacaggcactaagtccatacttgtcaaatcaatcatcaataacaaattttagttcctttagttccttagttcccaagaaccttctattggaagggatatttctcactcctttgggcctctatagattttacctccacatgttttacagatttattatattctacctttcactgtatttacataatttatctctgttattggacaagtttcttatgtacaagctccatgttcaaatcatctttttttctctagatgataaattacacagctttgtgtatattctgactctaataaatgtttactgaattaattaacgaattaaaggagtttaaatgttatattttataactttcaaataggccagtttatagagagcatatgctttgagattagacgtactgggtgataaatctaaataggtaaatttatatcagatggtggaatatctagtatcgccaggtaagagaacataatagtttagaaactggaggtttgttgaggatttctgaaccaaaaaggtatattatcacagctcatactaatgaaatgaatctgtccttaagatacattttatggtacagaaatacagttctatcctgcattcatacttagagtttggttttggaagaaagtggatcttgctactgttggtgattcagaacttttttcagagttttggaagaaaaacctgaatacagaagataactatcaggcccattatgttggtactgtttctcagtgttacccatggttctaactctgataaaattgctccagtgcattctctaattacaggtaacccattattcagtacccaggaatgtcgcgagagtagatttgtatctcaaagctatgcttaatttgtttcccaacaggttctctgactctgaaaacacatcatgttcaggattccaaaatgggatttgtgatcaacgccatctattcgatggcctatgggctccacaacatgcagatgtccctctgcccaggctatgcaggactctgtgatgccatgaagccaattgatggacggaaacttttggagtccctgatgaaaaccaattttactggggtttctggagatacgatcctattcgatgagaatggagactctccaggaaggtattgtgttacaattctcctctgcagagtagagactgaataacagccaactcttgatcctgaaatgtctctttctctcctttgtggttaatctaggtttcctggtaatgtttccccttccctgacatcccaaatgagcaaagatagagagaagaagccccatttcctgtggccaggaaaaaagcatttgtgctgatgtccaaaatgtgctttgcgaatcatcacatttcagagacctaaactaagaggcaggaaactcacatgatcatagataaataaaaaccatctctgtggtttctctgtacatgcttgtcatgttattccccatattcggatattttcttgcataatagaactattctgaaataggaacaatttgatttctggtaatccagaaatagggctgaggttctgttctgttgtttgctgtacgtacagcaagtgaattataagtcacattttattttattattctccagctggatcactttcttccttgttaaggactaaattgttttttttctctgaaattttaccttttattatttgtagaggaacttgaggaacataaactcataagtataggtcagtccccagagaaatcactaagtacccagaacttaccataattcacatttgtcttctactccaaattcttaaatgactctacatagtcatttaagacttatagacacttttaatctataaggaataatgccattgaaatgatattttgagttgtagcagggctgagtcttcactcagccttgtatcaaaacaatagggtcctttggtctctcagtgcccttctagcaatagctcatacttaacaactgtgcttggaaaactgtctatacactctgtttgtagttgaccctgccaaaaggtttcatgaatccccaacaattcacaccacatgtgcccacacattctgtcagcaaccttggtttatcacacttctacattctaagatgagctggagcttatcccaaatgcagctgttactatttcacatgccagacttataagtgatagctagtttcaggtcatacagccaagtgaaaacccaggtttttttttttctattccagagacttgaagaatattgctataactaggctgtttgccaaaataagctgaattttcacatgttgttttctactttttggctcttacgtatacccatgaaggaaaaaaatacaagcattttctcagggccaaacaaaacttcacagttgtaaatcttttaagggcaggctgaccaatgagctcagtctttaggctcaggtcaaggcctgggctcagatacctgcacaggaatttattattcccatgtgcatctctagagttctgacatcagcttaggacttgctgatagaatctgatgactgtagctccaccaattcaagagtttttatatcaggtacccaaaccattccgcaaaccagggagggaggagatgcctcagaaggtccagctctattccaatgggaaaccttgatggatctggcagaacatcgctaccttattcataatcatccaaatatgttgtaagggtttcttaatctttttttggaacaatcatcccttcaagactcagacaaaatgtatagctattctttcaagaacaacatacttaaaatcttgcaaacaacttctgggaattcaggattgctttgagtctatccttgcactactaggtttgagtataacattaacccatgaataaattatcagagttggcctctaagggcatgaagcagactcaggaaaaggtgatttaccaccttttgtttctccaaataatccagttacttttacaaaaaaaattataactagcatatattgagtgtgtgttctgagccaaagactaagccaagtgttctactttttaatcctatgaggtaagtaatgttaccattcttttttccagctaaagaaaaccaaagcttacaaaagttcaatgacttgcccaaaaacacagtctagtaaatgatagagtcaaaattttaactctgtctcctgggcttcaacttctaacattatacaacagcctgacaattaatcaaccaggatcaaaattttaaagacactatattctgagaaaacttatttgtagacattaggttgttatttttgtggagcaaaagcattctgccagatcaaaggcattcccagctgagtgagaaagcaaaggatcctggggtgattaaggaatcctctacaattccagagttaaaagtggaggatcctaaacagaggaagctgagagagatggcaactcactctggcacacacttgcagactgttagcacgttttaatcattgtttttaaatctctcatctgattagtctactatcagtacccaatgctctaatgaaaaccatggtgccaggtgttacagaacccagaatttttgaatttacaaaagcctaaacaatcatataatgcccctaacataatatgtaatagcactccctaataaacacattaatatttctgcagcaaaacatacgaatattcacattgtgataaacaagactataaatagcctcatttagttccagtcacatttcatccctagataaagttcaggtaatgtcatgttttgctgccaagtgagttacaaaaaaaagaaaaaaaaaatttcagagctctaaagatttcacaattaccgataagaaatatggacctttactattttaccattaacagactagatcaccagtcatcagtcatcaaactatgatctgcagaccacatggagtctgctgcttgtttttataagaaaggttttttggaacccagtcacattgatttatttaggtgctatagctgcttgtacaccacaatggcagaggtgaatagaaaccatctcaaagcctaaaatatttaccatacatcccctcacagcaaaagtttgctaatctcgggtttagggactccattgagaattaaagtttaagatgcgtggctgccacccggaattgaccataataggcagaggaaacgtggacacccaatgttagactgagtacaactaactaattaaagcaaaaaactaaaacattatattgtggggtttgtaagtacatgggtgcgaagtatttgaaaacaacggcaaaaatgaaaaagaatttgaaattgcacaaagccaaatttcttatattttacattaagtgactcaatattaagtagaataaaaatgcatattgtaatctcttgagcaaccacaaaaattttaatacaaagaggagcatttaaaagccaatagagagataagaaagaacaaaagagagagaaagagaatgagagaaagagagaaagaaagaaaagaaaaggcccaaaatagggcaggaaagaaagaacagaggagcacaaacagatgcggtaaatagaaaatacgaggctagaatagtagaaatggcagataacgactttgtgtgcatgcggattcttgatatatgtctctgctcatagaaacagatgttctgcttcaatgtccagattgtcctggtaaaaaatctgtgtcatagaaagaaagagacatgtccaaggttgcatagtcaattaaataacagggcaaggacatacgcaaatctcaggcacaatcatcaagtaaaaatttaccttctttttttttcttatattacatttgaaatggttcaatgtattaacatatagtataaaagtgttgcattattaggtgccattcacatttttggtctaactaactctgtgatctctcattactctgtgattgtccaaccccaaaggcacagatcattgtaattgctttgttgtatggaccagggcttattatgccaacccacagataatttagcacacatttaagaatttttaacaaaagcaccttagcatcggaattatagattgaaagagccttaggacccacataaaagtaatactcttcagtcttctccaaatgatttttcactttctctaacaacaaccctgtttcagccccttgaataaatccctcattatcatctgaagacaatcttctctaattttcagagttctagccatttagaaagttccttatttctgtacaattgaaacctgactttctctagtttaccttaaatgctttaatagaactttttgttgttgttattgtaacatattttgtttattttgattttgagcaatatataaaatttatttttaaaattatttagaatattctaggtttaaattttggctggttaaggaagagcagacatgaggagttagagagtaaggggaaggaagggacaggtattaaagaagataaattacatatacaaacacactgtgctgagaaaaacatttcagaagcagagaaatatagaaaccaagaggtgcaatgaaaaagaaaggccaggggagggtgagggaaggggagggagagggggaaggggtgggggagagggagaaggagcaggaggaagaaggaggaagaggaggaggaggaaggaggaggaggattgaggaagaagagaaggaggaggagataaatgggaggaaggagatgggaaggagaaaaaagaaactgggctggagatttatattaaagtgtcttgtgattggaatgacacactaatctttgcttctgacactgaatatgtgcaagttggatctttactaaagccatcaaaaacaaagagcacactgaattactgttttcttgttttgttttgttttgagacagtctcactctgtcacccaggctggagtgcagtggcgcgatctaggctcactgcaagctccgtctcccgggttcacgccattctcctgcctcagcctcccaagtagctgggactacaggcgcctgccaccacgcccggctaattttttttatttttagtagagacggggtttcaccatgttagccaggatggtctcgatctcctgacctcatgatctgcccgcctcagcctcccaaagtgctgggattacaggtgtgagccaccgtgcctgaccttctgttattttattggaaaacaaaatacagtcttctagattgaatcatggctaaagattgcaagaagccattatgtcttttgattcttaactaaaagttacgtaagagtatgttttaaacactcactttattttccttttgttggagaataaaagctatattctatctctgaaaattaaaagggctcataccaattcacaagtcaacgggagaatattcttttgtggagacatattatctatttctcttttttagtgtactaaaacaagatttttaaagcaatgttctattttcacagcttaagctgtgagtgataatatctttgtgtttgccttgtattaagaaacaatgactagaaatctaaaggctaattccaaagagaggattcattgtctctaatgtaattataacaagtttattgagttcaactgaaattaaggtttaactttccttaaaacaagttccctgtcaaatgtgattttccaatctatagagttttcatgtttatttttcaaaaactggatctctttactttttactatttgtcatacataaaacaaagaggcatggatatagagataaaagccttacaatataaattggttcaaatttttacaatatttaagcaaggaaaatatgatctcttagctctacccaggatttggagcagtacccaggatttggagcagtctaataaggaagaaggaactgcagacttgaaatctaaaggcttggtttaggtcctagctctgatgcttacatactctgtaatctgtactaattaacctcactgagcttcagtccattatctgtaaaattaacagtgtgaactaaacttttcagacttaagaattgctagaaacagagttgacagctcatttttgagtaaggaatgacacccacatatttcttcaaattatcagcagcaaagaaacaagtctgacactgacatttctctttctcccatcctagaatcttcaaaggttatttgctcatagaaagtcaccctttgaatacttaaagctcatatatttgaagtagccaatgacataatacgtgagttctttttacctcagtgctctgtgctctaatatctcaactcattgcatgcacagaggccaaaggataattgtgaccgagagggaaggaaagtatcctataaattggtatttttgatttagaagtagaatttagacagttacaccaaattgttactgactgcaggaaaattatcaagttactgaacaaccaacaaaacaagaatgaggtaatattctgaagaaaaaaaaaaactacagtaaaaaatgtgactgggagtgaaaacagaatggcatcattttataacataagtttcaatagattgatgccagttttgttctcagtatttctgtacagaacattggtttgtgtatagtaatctcatcacttgaatccaaaagcgagaacattttccattcatatcagtttccagatagctacacatgctgagcattggaagttggaggaggcatttatatgtctatctgtcagtactataagtcctgagggggtaaacagtataaaatattatgtgaacacagtgtgtacctgagacatacctgtagaaactgagataatggtgatattgcttatccaatatcctcaaattggaaaattatttcagagattcttctctagaaatgagcttacttataagaaaaggcttgtaagttagcacattgattttctctttttacatttctatccacatactcaaaaaacaatagctagcaaaggctgagaactcacaaggaactactctcttccaggatgtttacattgcatgaggtgctttagaagctattttcaaacttttttaaacatcactctcaaaactatctttgtacaatgaatttagccattgataatgggcaaagtaagaaaggtaaaatgaggccctctgtaaattatccctatatcccctaaagctgaaaataagatgaaagatttaccaaatttctcacttggttagtaaatgtaagttttatcattttacttgaatacagacaaaaacctttctatcttttgtagaagcctaacagtactcgtttaaacttcttgaagttatttcgaaactgtctttcatcctgctggggtcaagtcaccttctcacatgggattactttctatttcaggtgtaagcttgaaagtacaaaaatggtctctgcagagaaagtaaaatagacagattttttttgttattctaagtgtactgtcatggaaaattccagtgctacttatatgacaatagacacatttttgggaataaaatatattgccttttcaaagctgagtatttacatcttaagctgcataattatcatattcttattcctaaggtatgaaataatgaatttcaaggaaatgggaaaagattactttgattatatcaacgttggaagttgggacaatggagaattaaaaatggatgatgatgaagtatggtccaagaaaagcaacatcatcagatctgtgtgcagtgaaccatgtgagaaaggccagatcaaggtaaaatggaatctatgtttctttcatttttgttgtaaattcaacagtgttaactatcattggctatttttaaaaattttagacacttattttactttttatattgtaagcttctaatgtcagaaattctcactcattccttgtgaaatcccatgtgcaactcacaatagtcttattagttggtttgattgaaccagttgatgagtcatgtttgcccacaccgtttctgctcatacaagcctttaaagacatgacttcctgggaataaagtttacagttagaaaagacactaattctaatttatttaataaatattcatcaaatgtttattaatataatagttaatattgattaggcaaaaataaatgagacacgctttattgtcagaagacttacagtctatgtgagaaaatatcatggacacagataagcaatatcatgtaaaatgtgatgattttgttaagaaagaaaagaagaggactatataagtttgtacaaaagggatagagatatttctactgaataaaatgtcaaacaatggaccatagaaaatgaatatgatttcagggagagaacattcatatagaaagaacagtaaaagaaaagggacaaaagtggtcaattgaagactgtccagaaacaagtgaataatctagagtgcaatgctctaaatggttattataaaagagaaagttgaaataagttgaacccagatttgtggagagttttgaacatcatactaaatacattgaacttaatttttattaaactggagtcagagaataattttgaccaagatgctggcataagttgagctgtggtaaggaagatgaataaacaaatttatgaaacaagaaagaagagacaagttagaaggatgctgtgatagtggtaacaaggccttgaattagggaagaaacagaatgaaaaggggccagaagacacatttggagaaaacgtttgtagattcaatcaggctgacaaccaatttgatgccgagttgtggaagataaagaagtcaacacaatcaactgaaattctaagtgttagtaactaaaaggttgcatttccaggaatagaaaaatggggatggctttagagaaaaggcgattggttagtttgtgggcatgttggttttaaaatagccatccagtgattaaaagcttagtctagagcaatgaaaaataaagctaagaatacagatttaggaattgattgaatagagttaaagttgaagctattaaaataaataaaattgcagaacctaaaagtgtaaataaaaaataaatacggaccaagaatataccttggagaatttctgctttcaaagtacaaaaaaggaagaaaaggtagaggctgagcagcaacaggtacagagagatagacaactagagagcacactgtcacataagatggtagtcagtggaagagaaaggtcaaagaagaggaacaatgagggaaaggcatgaaaattgagggttcacccttcatctgggcctgccagattgaatagaatgtaatggcaattgagtatcaagatgaatggataaggaaaatgtagtttatctacataatagaatactattaaaccataacaaagaatgaaatcctgtcattcacagcaacgtagacagaactggagaacagaatgtgaagtgaaataagccaaggacagaaaattaaacatcacgtgttctcacttatatgtgcaagataaaaaatgttgatctcacagaagtaaaaattagaacagagcatactagagggtaggaagggaaggaggaagagagggataggaagagctttgttaaaggaagcaaaatcacagctagataggaggaataaattctagtgttctttagcactgtaggatgaatacagttaaaagtaatctatagtttcaaatagctagaaggaggatactgaacattcctaacatgaagaaataataaatatttgagatgatggctatgctaattaccctgatctgatcgttatatgtgtatcaaaacatcactatgtaacccataaatatgtacaattattatgtgtcaattgaaaaaaataaagagtataagaaaaagaagtatgtgataaaaaagcatgtaatggataatttggtaatttgaggacattaaaaaattactcttaggctaaagaagatgtggccacacttacaggaaatgaaaattcaatgaaggaagagaagacaaagatataataaaaagggagttagggcagctattggtatgcaatgccgtaaggaaaaatgatatcaaaataatttatttgctaatcaaacagttcttgaagcactaccacaccacatttcaggcagtgtattcctagagccattggacttggtgttttcaatcaaccttaccttcactctgtttagaaggcatttcatgtgttttttcatctgtgattaagactgaaactgaaatattttaatactgatagtaaggccctcaaagggtaggtctgaagatttggaaagcataagaccagaaagaagaaagataaggtaaatgaagataaaaataaattaattaatgtctgctaaatggctcaaaatattagatatctgaaattttctgtatgtcttattatggtatacagcaacagctggtaaactatggcccacagactaaatctgacctactacctgtctttgtaaataaagttttattaaaatacagccacgctcatttgtttatatagtctccatggctactttcctgctacagtggcagagttggatagctgagttgctgagttgcaatagagactgtatggcccaaagcctaaatatttacaatttggtcctttgtacaaaaaaaagtttgctaacacttgttatatcaagacaaaagaggttttcatcttggccaattatcttgcagttaaactcttcattgtgaggggtttaaattcatgtacaattatttacatgaattattacaccaagaatatccatattcataatttccagtgcttcctgtagaaagattacacagtgtaaattaccacataatttttgtttatttttgacccttcacagcaatacattttgaaaatgtaacttctagggccgggcggggtggctcacgcctgtaatcccagcactttgagaggcctaggcgggcggatcacaaggtcaggagatcgagaccatctggctaacatggtaaaaccccgtctctactaaaaatacaaaaaaattagccaggcaagttggcaggcgcctgtagtcccagctacttgggaggctgaggctggagaatggcgtgaacccgggaggaggagcttgcagtgagccgagatggcgccactgcactccagcctgggcgacagagtgagactacgtcaaaaagaaagaaagagaaaaagagagaaagagagagagagagagagagagaaggagggagggagcgaaggagggagggagggaaggaagaaagggaaaatgtaacttccacatgcagaattttttgtttttttttttgagacggagtcttgctctgtctccaggctggagtgcagtggcgcgatctcggctcactgcaacctccgcctcccgggttcaggtgattctcctgtctcggcctccagagtagctgggattacaggcacctgccaccacacctggctaatgtttttgtatttttagtagaggcggggtttcaccatgttggccaggatggtctcgatctgctgacctcgtgatccgcccacctcagccttccaaagtgctgggattacaggcatgagccactgcacccagcctattatcatatttttaatactggtcattttgtaataatatttgcttagtccttttttaaaaatcccaaactccattttcctaaccagatgtcatttttactctattaaatgtacaatttagaagattttcttaatatggtttaacagcgatttcattcatgatatcaacatctcatggcattttccagagtttgtaaacttagtttccatgaaaggatttagtctagtaaagtttcagatatgttatatattgttattcataaagaaagcaccgctgggtgggtgcagtggctcatgagtataatttcaacattttgggaggccgaggtgggagaatcccttgagctcaggagttcaagatcagcctaggcaatttagtgagaccccatctcttcaaaaaaaataaggaacaaaaataattgggcatggtggcacacatctgtagtcccagttattcaggaagctgaggtgggaggctctcttgggctggggaggtcaaggctgccgtgagccaagatggcgccactgcactcccagcctaagcaacaatgcaagactctgtctcaaaaaataaaataaataaaaaagaaagcaccactacttccagaatgttaaattgccatgaaagagaattgtcactacctcgtgttcaaaatagatgtgaaacagaacataaaatatgaaaacataaaacaatttctaaattatcagaggaaaacatattaagttatcactattgattcaaaaagagattgtaatgttggaattcttcttggaaaagggcatgaatttattttaataaacacctgaaattcacaaaccaatgaaaactgaaccataagaaatcaaggtatttctagtggggggaaatgcaactgcttttatttgctaatccctgctaagttctgaaagacactccttcagctttgcaatatgcctgtttgcattacaaaatctaataattgttcaaggatagttttgccaagtgtggtataccttgaaaatgaaattcttcatttctgtatatggacatttatgtgcatattattaatgaaataggtaacattattagagtgttctacactttacaaatcactgtgttgttttatttaatcctaaggaaatcctataaggtagatattattatcttaaaagcaacaggtccagttaaaagaaactgagcattagctggaggactactcaaggctgcacaactacttagtggctataaataagactagaaccctggtgctacttgattcccaagccagtgctctttcccctgcgtctttcaaaatatcacgcagtctatcttccagtaagactcaatgtttataagcatgagcatttgaagtccaacatacattgtttgatcccttatttaccctaacatgctatgtgagctaactttaccttagttttctcccctaagaaaatgaaaaaaataaaccagctacttcatacagagctgttctaatgttttaatgggataacagtatgtgacaagtactaaagagcctggaaatagtcgatattattatgaagaatactttaatcaggtctaaggagcaattttgcctcacttatttagttactttagggaaaagctatttcaggcccttttgccattattccctgcttgtatttttgtagttttaagagtcaacacaagaaatactacaaaaatgtaacaaacagttgtcagcttacaattatatttggctataggtatctagctgatgttattatcaaaggtcattactagagttagcatctaagactagaaatataaagtgtaatcattactgtctctggtcattgctgaatattaatcacagttttaattatttaaaagaacatttaatgaatgctgtctattccggagaggcttttcatgcaccaatggtggggaagaaaaggtacatctatttcgaaagaataacatctgtgactctttcaactgttaaattatttcaattattttccattaccttaaaaaagtcagatagattaagaggtatataatagtctcagtgacctcatctaccttcaaacaaaacaaggctaccaaaataggaaagaatgggttgaattgttgaatcagatttttcgtagaaagagatcaagagatcatctccaggaaaatcttaatcttttgctatgttctacccaatacaaattcctaattatttttatcaatatggacagattttagaagattaggaaatatacaatgttttttgctcacaattattcaactaatggagggaaggaagctaaggtaaatccagggagcagaagttcttaacttaaggaaaggagaagcagagcagatcctggggtgaattcagttatgtgtatctacatatgagcacaagcacaggtacttaattaaatacaggtttccaaggctaattatccaaagactttcatttaatttaattctttatcctgccacaagctaactttatgacgctggacttgtttaaactcagccttattttctttaattataaattaatattaaaaattgtactgcttatctgaaaacatttaaaataatgtatgtgaaaggcctttctgctttgcaaaacagcacattggaatatagaattgttggatttttatctatgcaaaaaaaaatctaaatttcaaatatttgccttaggtgatccgaaagggagaagtcagctgttgttggacctgtacaccttgtaaggagaatgagtatgtctttgatgagtacacatgcaaggcatgccaactggggtcttggcccactgatgatctcacaggtaatctatcacaatctcaccacatataaattaactgaaaaatggtgcagacgtgggagaggggggtcacatccccaagcgttactcatcttgggtagtcttatttatggaacaaataatttccttgggaacacaagcttcccaaagtctgagctacttattcaaatcttcagacctctgggagagatctgcctatatgtctgtcttcactccaaaattagatcagtattcctagcttgtctactgggcattcttccctcatgcccaggacattcccagaagttcctaaatagggtcccagttatgtgtgtcattttaggtgaagagaaagaagttttagccagtgagaaaaatatgtcatgacatatccaagaacaaaaagatatcaccgaattgggcagaatgtcatctaaagttcttttcttctgttaattgtttttattaattgaaatcaggagtctccaactaatatgcttttaagtattgttggcacagggaaagacttgattttacttgtttattttttttcttttttgttttgttttagcttttgcttctttgtgccaacagatgttaaagaatatgtcatcatgttctccagtctatatttcatagtcttttctaatttttacaatatataaacagaatatgattcctttcatactgtcttccaatttttcttcaataaacatttattaaatgcactcatgtgcttattttcctaccactaaaataaaaatatagaaataaaagtactacctctatcttaatgaagttcacagattaataaaggaggcaaaaaagtaaaaatatgattacaatataataagaggacatagatttatagacataggagcatgaggagggcacccatgaactgagtatgcaagaaaaagaggaaaaaagccttgcaggcagagagccctccatgtggtatgtcaggttgtctagtggttttagaattcagatggatttagcacaaaacttctagaggctagaagatcataaagtcatcagtattagactccatccctcccaggatgaatgattttactcatagtagttgtattcacttatttaaaaagtctggttattaaaaattccatgatcctgggtctttcaagacagctcacctttctttggtgattggtatgtatacaggagacttttccttttcttaaaaaaaaaatctgatttaataaaacatccaagtgccttttgatcgcatttgaatcttatttttgccattagactgtgagctttctgatgctcttattcatcctgttttccccagttctaaacacaaagccttaaataaattttgttgaatagatgatctatagtgtacctgtgtgcacacacacagtaaaaatgccaaaaagaaaaaaatactatgattggttttcttgaagaagggtgaggagcagtattcctatcttttctttatactatttatttacatgtttttctaattttaaactggattattgtgaaaataaaaaactgtcttgcatcgtcaactaacttgcatggctaagcaccttgtgaatgaatatacagatgtaactttttgtctcatgttctgtaagactatgatattgagaatgaacacacactttcattatttcaacagataaatattttattattactatttccattataatattaggtacttgagaaattgaggtggaaaaacagcaatgcttcctgtgtcacttgttgcctatatcctggtcctcatacatcttaccatcttgtggggaaagagacataaaacaacacatgcacatggctagtcagctctttgtttgctaatgggctatttgtgtgcctcactgacaaattatatatgaagtcaaagaacaggaataaaaacatggaaatatccgagaggtcgtaatttaaatttgtggtcatataatttctctctgaagaagtaaaaattaactgcgacctaaattataaatataaatatttagcaaataataactaagaagaaatttcagtctggggtaacagcacatgtgaatgtctgtatatgggtaagcaggtaggagaacagtgtcagaagaggtgttctcatcatctcatatttaaatattgcagtaactttccaatttattcccttgcccctagatttatgccacatgcctcttaatccacttttgatcttgctattttttcaggaagaattcaggtctttttttaatgacaggaatggcacagtttattattttgagacaattgttgcagacataaatatttaaaatttcctaagcaaggtgcttttaacaacaaaaatttttaaagttggaaagagccaataacttagatcatagctcacacagaataacaaatcaaagtgtactccattatctccctagattttgcaaacaatgctttgtctaacacttctttaaaacaacaaaggagacagcaagctgaaactttttccaagcacacaagaaatggtgtcatcacattacttgaagaaggtgctgatgggagaagatgatcttgctactgaataatgtatccaaaatacagatctgtcttttttatttccttgctcatgtaggagaaagtaattatcgtttcttcccagcctaggtttgtggattaaatccttggaacaaaacacaaactaacaagagaaaagcatgtacatttattaaagataagttttacatagggaaaggaaaacacaaagaaacaggaaaacttgtgtatttttatgctaggtttgatagagaagtggtaagtcattgaggagtatgattggattaaaaaagcatgatctaatgatagttagctggggagaactcagctattcgtgtttgttcagattgctgtcagtgaccttgcatttttagagatatacagatgttcacttcctctgggtacagagagagaacctgtcaaatgagagttttatgacctgcttcaggggagaatgctggggggaaggtgagagttaccttcctgcttctgctgttttctcaaatgccaaggtgccacacttcagggtagtgtgtcctgaatcccatcactcaaaacttaccactggttttataactctgtatgatatattccaagctttcaatatgacatacaaaatgtcctctttcccaccctcctatgatctttctagtttcaatcaccactgctttccatctttcattttacattctgttgtcaaagactgctgataattctcatccacacagaatgctattttattcctccctgtctgtgtacatattgtcttctccacctggaatgtgcttacccctctttctttacttgagtaactcccacttaccctcccttactctgttcaggtgttactttctctatgaagctttctttgatatacttagactgctaagtttccccttctgtatttctaaaacaaattctgctttcccctttaaatcactttgcaaactaaattttaatgatctgtatacatatctgccactcctactgaaatgttagtctctcatggacatagctgtcccttaaacatatttgtaatctcagcacctaatacaatgcctgacatagagtaagctttcggtaaatacgtgtcaacctccagtaaaatgatggagagtgttacaaatgaagattaaagtaggtattaaggccagcctgtgagtaaagcctttaacgagtttggaatttatcctatatagacagtgtggggccagtggaggttttcagacagaagaataaaatgatttgtctctggctaggtgcatacatgtgagtgtgtgtatgtgtgtgggtggtctgggtaggggaaaaatgccaaacctagaaatgcctttgcattgatattatgtgaagtttaacctttaactggaatctacagcacttttccaaagagcctatagctgtgtgcaagcccacctcagtgactctgattcaaagtaacacatcactcggaattgctagctagaagaacatcctgatggcttcagctattccaaagcctgccacagaaaggcttggggccagttttaggaaatattgcaagcctttcttatatgcacttggcttatagttaccttacttcagcctataatgtgacagctcaagttacctttgggtcagtgccttcattgtgataataacaaccagtacatatataatgctttctatgtgacaggaactgtttgcagcatcttggaaatgttatttcattttatgtcaacacaatcctataagattatcagcatggctaagagatctcagcccacctggaattaaacaattgttcagaaaacaacttaaagtagcaatcaactgacattaatgtctacctatatatttagccatatactttttgtatgtgtatatatttttttcatagaaatatcctaaatgaaggctacctaacgttaaggtgtttacaggtggtaggattacaggttcctttttttacacataaatacatgtgaatatgtgtgtgtgtgtgtgtgtgtaaacatgtatgcagaggattgaatgatattatgagaatgtatcttcatcaataaaaatcattaaaatgatgtttaagccagccatattctcaatagcagtcataaattcttaggaacaccagaattaggtagacaaataaagaatctggtatgaaaaccaagaagacatgaaagaaatgagaaataaatggaggatgaggtcagaacatagcccatgtcctcaattcaacttattttcattgaggacagcaagcagttattcctttgtcttataattaacaggtacctatgctagcagtaaataggataaagaggatccctgccctcatggagataatttttccaaatattgaaagtaataataagatactgaatattgacaacagagaaggccagaatggtgtgagagcccataacagtaaaagctaacttaggtgatatttaaaattgcctcttcaatgaattgtgggcatgcaaaaattggagtaatgatgggagctggccaaactaaaatgaaagagaagagtgttgtggacacagaacacaggaactgaaatggaactgagagtataagggagaaatgagacaagaaagcaaaggccaccttttggggagcctggtaaactatggtaaatattttaaagtttatcttaagggaaatttaaaaagatttattcattcagtcatctagtcattcattcaataaatgtgtatctagcactttcactgttccaattgcaggggaggaaatatatattttccctctatccatcttaggttcattggctggggcccctgtaactaaaaatagattaacaaaagaaaagcatacacatttatttaatataagttttatgtaacactggaaccttcctaaggacctgaagaagcagttaaacctggctgttcgtatgctaggtttgatgtaaaatgaagagttgtagagaaagaagataggacaaagggcataagtaaactcaggtaaacttagcaaggcctgttccttcagactcctctgagatagggatgctccttccctccaggtctaagaagggcacctctcacatgagggtcttatgacctgcttcaggggtgaagggtgggagaaggacataaagtctttctgcacttgctgtttctcaaattccttcagcttaaaaaattcaatatgccaaagtgccatattttggagtagagtgttgtgaaccccatctcaggcaatgttctaaatgctgaaaatatttctatgaacaaaaccagtaaaattatctgttcttataatgtttacattctagtggagagaatagttttaagcaaggtgattatctccaggaatattcaaaaattgaatatgaaagaaaatgtgccaggtgcagtggctcatgcctgtaatctcaacactttgggaggctacattgggtggattacctgaggtcaggagtttgagaccagcttggccaacatggcaaaaccttgtctctactaaacatacaaaaaattagccagccacggtggtgcatgcctgtaatcccagctactcaggagtctgaggcaggagaatcgcttgaacctgggaaacttaggaggcagaggttgcagtgagtggagatcatgccactgcactccagctcgggtgacagagcaagactccatctcaaaaacaaaaagaaaagaaaagaaaagaaagaaaatgcaatcatgatgggctgctttataaatattatttacatagtcacaatgtgaagagtagatattgtataaaaacatgaaaaggaaggatacagatttcagaatagcagtatcatctagtaagagaagaaagggagttagatgggagttacaaaataggttttagttatagctttagcatgtgtgtgtgtgtgtgtgtgtgtgtgtgtgtgtaatttgaaacatatgacaaaatattaacattttttaatatagattttatttgttccataccatatacttttctctgcatatttaaaaattttataatttaaatgattccatactatttgcgctatttaaatatttaacactaaaagataagattttaaaatataagactaagttgggaattataaagagaggataagggtaagaaaattttgcaaaaatccatgtgaatctaccagtggtttgggtaaggataatgtaatgtgaatcaaaagcaacaaagatttgattaggaattaaaatcaatagaacaaggtaattagttctcagaaaaatgtagtctggtttgagagagaaaggagaaaaagtaataaaaggcaacaatttgagctagacgttcagagaattatctgaaaagcatttgccaagacactttttctgggacaccattccctgccacatatctgcaaaaactgtcctagaaagaattttttatttgttttgtatcaaagaatttaggaggagatataagtagtaagagctctaaagatctttaggtccccagtccaaagccacagaaacacttacaggtggggcttaccagatgctgccaaccttccaataaactaagtaaaaggaaagagcaaaaatagcctgtctttcaagaagtaaccaggtgggaagtcctatgacaggaagttagcattatctcctgcttttcaatcataaaagaaatgtatcttacgtaagtccaaagctgtaaaacgcttccattttattccatccaaggcaatatgtatcaacagcttaatgtcaatagggacgttctctaggaagttcctttggttccctgagttacctaattgctttggaggttggaacatttgtctcttcacttaagaggaaaaaagccgcagagttaaacaaagagatgttggtaagaatcaaggagggagcagaggatgagctccaagaggtgtaaccactggcaggttttataactcccgcattggaattgctctctttttacaaatgtgcatttaatttgtgttcctcagcttgtcctacttttcttgggactttttttttttttgccttttaataaataagcacattaaataaaaacatggggaagatttcttttcatttccaattattataactatcttaagcattaccttttttaatcctttaaggttgagattattattctacagttgaatgaaacaaaactcaggaacattctatacatggacaagaccacaaaactggtggaaaagaaatcccaggtgctatgattctggggtttttatgctatactacctgtctctctccacaatcacattttagagccccatattttcaggaaattatagaaggaaaaaaaatcggcttcaagctggtcacatgttaattatctccaggctgctctgatattttttattccaaatgtgcttaaaatgtgttatttgactattataattaaacttagatgaggaaaggagggaaaattcttggcatctattaaatattatttgtttatgattctttagaggaaatttctgatgagttttgatgagaaataagtttagtttattattacaattttaataaatatttcttgttaatattgaaactggaatagctttcagaattctgctatctagcttcttggtttctaggttagatagtaatctgaacaggagcatatgctatacagctggctatctatcattcattaattcattcagcaaaagattttatcacattcctactctttttttaacactgtgctaagttctgatgatacaaatataaatggaaggtacctaaccttacttaaataattgcattaaattatacatataatgcatacaatagttaaaccacacaccaaatgcagtggtggcacaaaggatgaaattattcattagcacatatttgagttccaactagtgccaaacatagcactagatccagtattgggcacacaatggtgatcgagccccacttcctactcccaagtatcgcagagcctaggcagagacatatgcaaataaagaggcaatttcaatacattaagtatccctgccatagtgtaggaaccaatttaatgtttgtataatgaaggaataaaagagaggagaggaaatgaagaaatgaatgaaggaaggaaagaaagtgctaggatgggagtaaacgttgatgagaggaaattaaccaggtcttggaagttcagaggtagcttctgggtggaaagggaattcatgtatgtgaaaataagatgctaaccaggtaaagcagaaatgaattttcaggcagaaaaaaagaccataaggaatgatacatgtcatatctaaggaatgtatgtgtgtctcaaaatattttttccaatataacattcagagcaagtacaccaccatttcacggtcgctttttcatcaaagcctctattatgggaactatcctttcctaaataccaaacatcataatggtgatcagctgtaaaagaaagtgacttttgtttaacaatagaattcccaggtctctaagcactttttaggtttctctagataagttcactacattacacactcaccagtacaatctaaggaagttgaatttatggcaaatgtagtgtaacaaagtacagctgagaatttgtgctgcataaaataccaatctgcaacaattcatctttattttcttctaagagtgtagtggtttaaatcaaaaggttttggagtcaaacatgcccatgttcaaattcacactccaccagtgactcattgtgcgacttaaagcacggaaatttttatctgtgagtgtcagctttctcttccataaaattgagataacagtagtaactagttcataagattattagagctattttatagcatacaaaaagtttcgtatgcattaactgttcaagaatactattatcactctactgttaataaagtttttaaaatatagtgatgaaaaatgaatagagagatagatggattgatttaagaatgaatgaagaagaaaatttggggaaagttttaacctgtgtttatttatttatttatttaaatttatttatttattgagatggaatcttgctctgtcgcccaggttggagtgcagtggcacatcactgtctcagctcactgcaacctccgcctcccgggttcaagcaattctcctgcctcagcctcctgagtagctgtgactacaggcgcatgccaccatgccagctaattttttgtatttttagtagaaacagggtttcaccttgttagtcaggccgcctcagcctcccaaagtgctgggattacaggcgtgagccactgtgcctggcctaacaggtgtttattaaatgtcttctacatttgaaagtaagatccctttaagtcaatgactgtctagcacaatcaatggcagagagtagacaatttttatttgttgaactaagcttactgttataaacatctcttttaacttcgtttagattagcttcatagcccttctgattctaaatgaataaattgcagaagtttaatggtgacttggaaatcccagaaagccgtaagccgtgacaatactacacagcacctgccatttgtttttctatcttatcattgtccctgataaaaaaggtttctagtttcactgatcacttcattatacacttttgatattttcctcactggcaaaataaaaataaaaaaataaccttcccaaaaaggatctagcatctattgccactgatatttttacatttatgaatttcaaataaaatgaaggctattgtgctgaagtgctccagagctcagtgttgatcctcttttctgtctacacttgcttcactggtgatcatacccagtttcattcatgtcattaaatatcatctacacaataaacattttgatgtaaagtatcttgtccagatctctcacctaatctccagacttaaatattccattgcctacttgacatatttatttgaatatctaatagatatcttaaattctacacttccatcactgaaatccaggtctttaccttcttaatctcccaggctgctttatccttactattacatttcatctgataataaacccgttctttcattaggtaagaccaataactttggagtcaatctactgacgtcttgcacatcctttagtcagtaaagaaatcccattggctaatccttcatatcccaaattccaccacttctcactacctccagtaaaagtgtctaacaatcatcattaatcatctttcttctgaaaataacctcctaacttttctccttgattctacccttgcccctacttacagtctctcctcaacattccaggcagagatatctttttacaaaataagccaggtcatgttactccattgtataaggatctacaatgatttcccatttcattcaaagtaaaagccaaagtacttacaaattcctgttttgtatgacctggtcttctgtcatgtgtctgacctacttttcccttcacttcatctggttcttcctcccaatacattggtctttttgttcttccattaaaaggtcagaaaggctcttatcccagggtaatttccctagcagttatctgcctggaaggctttactgcagataaccacatgaccactattctttccttcctcaagtccttgctcaaatgtctaccctgagcaacccgtttaatactacaaactaacccccctcatatccagttctacctcttcttttctctacctcttatatcacctcatactattttatattgtttatgtgttaatgtattttcactgatcatatactgttgatccttcagctaggatataagccaaaatacagtaacttttgtatattttcctcatttgagaataccaggctgctagaacacagtagatattcaatgaatattcactaaagaagtgaatacaggatggaagaaaggtaagaaatccccatgtattgagtacctgtcacctatcagaataggaagtttgtgttctatcacctaatcctcctgacagctcaaaaaggttggaatccctactaggtacccataaaaattaaaattataaaaataaactttaaaaaaggttggaatcatgatttccattttacagaaaattgagtttgaaaattgaaaatatccatgctcatgatcacacagtaagcaggagagtaaggctcagaccctgtttcatctttctgtaaaactagtgctttttccttgacatgatgctgcaggaaatatggaagtgattgtgaatcaatggattctttctaacaggatctctaaaatgcaatgaaaaattttgtgcactgtcttttttttttcaaacagttagcttgataaagttgtttcagttagcactaaaaacaacaatgttgtgttctggttcttttaaaatgagattccagggcttacacattgataaattctaaaatgccttcttactcttccaatttctcaacgttcattaacttttaataattttcttcctacaagatgagtcaaaaagtcagtatatttaaacttgtaaacgccactgactaaagaagaaaaaaagggctgaaagcccctctcttagtggaacttatcaaaacaggtccctgaaaagaacataaaccagttttcatcttgccagaaaccactcgatgaaaaatgttcaccatgttcttcttcacaatgataaatttgtggtctgaccaaaacaatggcattgtggtcaaaaaccactctgacatggccagactgaagacaataatgtgatttcattgatttcagtttttggtcaatgtagcttacccaaaataaattatcacattttccccttagaacaagaaacattatgatacagtgctaactattgcattatctaacctacttggaaaatgcttcacaaagcattgatatattatatgagtaatatgaagcagataaattcctcctatcttgacacctcttaaaaaatcacattaattgaggtgatgaaaaattcaaagcattatgggctgtcttgtacttacagacaatttaagacaacataataccatttacttggggcaacacatacctaaacaagctagagagagaaagtagcctggcttttccccagaataataaaggataatctaataaaacaggcactttagcagatgttgagtcacaccgttttgtatatacacttccccatttccactttctctcacttcataattattatgccactgtccaatttattttatatggtcctcacactaatccttgagatgtaggcagataggtattatcaccttccctcctaaagcttttgctaattccccatctgaactatcagcaataattcccaaagacattgtaattctcttgatacattactatgctgtagagttttttcctctgcatatctgacttttgcattttggctgtttcctttacatttcttctgcttttctctatgtctgtgtttctctttctatggttcctttcaaatgctctttagttccaacagaaaatagtttccttaactgaaaatagatgaaataatggtccctatcgcatgaggaccttgtaggtattaaagaaggtaataagaataaagtgttcaatacaatgactagcagagtaaagtcacagagcctgagcatttggtcaatacattattttaaaggaacaaacaattacctttctatcaccatagtgtggaccaagtggtatgaatggtgtaggtgctcaagagtgaaatgctgtagctgtgctgtgtgaacaatgttcaatctctttaatgggtgggatgaggcattaatctttccccttgtacatttttcttacatgtgtgcactttgtccccatattttctttctgtaataaacatgagcatttgaatagttaaatgtatgcccatagctcaactggagaatacttaacgatacttaaaatttaggaacaaataggcttggaaagagaaaaaggaggtaaaatctgtggcagaatatgcatacaattttgcaaccttccttaggaaaggtaatgtaatttcaggtcttagaatagtcctggtatgcctcaaaggaaaaaaaaaatcaagggtatatgggaacacagaaggaatatagtggggcctggagagtggttgcaaaattctgagtcacaaaatcagaaagttattgaacatttggatggatgaccagctacagtaggaaagtgctttttagtatgcagcttatttgcaaaataagcaattttatgagtctgactaaaactgcaggaaagggatcttgacaagggtctggcaagctagcaaggataaatagaaatgaatcgtaaaatccaaattatagctcctattatgtgtgcaaaattccactgataccctatcggttttaaaatgatgagtttaatgttttatttcaataaaatacaaaaacaactttaagcattttataaatttatttctgagaaattgcttcactgacctttttcaggtcattggtctttaatttctcatctgtgaattcttctgcaagggtttctccagattaaaaccctaattatagataagataagtctgtattattttcattttatatatgaaaaaattgagacatagagtaaaaggctcatattaataggaaatatttgtgtgcaagctgaaaatgaagggcatgcctccttattccttacttgccctcttctttgttaatcattcattcattcattaaacttatttaactgcctattgtgtgccaggtactatgactagcactagaaatacaacaagcaaagaaacagtctcctcctctcaaattgctaaatctaccatttcaaagagacaatactaatacacaattagtaagaatgcaagtgctatgacgggtacaggcccagggagccatttgaccacatgagaggaacctgtcagtcagcttcagggaatcagaaaagtcatactcatcaaggagaatctggaaagtagaagaataaggagaagttagctagtaaaaagggactggagaaaagtagaaagggagggaattattccagtcagcacgctttattatttaaattcacatgctgtgtttttccactcttatccatgtgcagtatgaccggaagtcatatttttcaaagctatttcctacaaatgtgcatctgtgatcacatttccctttagtactctgcagtactattaaatcattctttatgtcttaattataaaataaatctttgcacacaatttcaaattcccctataaaatataaccaattaaaaaaaacaaaaataaaaactatagctgtgaattttcagctctgtgaaggaattctattaaggaatctaaaacgagatgtgtaataaaccttgaaggatggggaataggctaggtccaatgacaaatggatggctgtgagtctactctgtagcaaagttgggaatgtcccatgaatgatcattcagaacattttctatgctagaaaactttaggaacccaagaaaaacaactgatcaatcagtgtctctggcagcaactctaaggacatatagcccagaacgaaaatcttgctgaagggtttgaaccaatgagatttctcaagaggaagcatggatttatatcaagataaagctatcaaatatttatgccaccactagccccaccttgcccatgcagacattgttaattaatcatgattctgtttcctactaaatagactcaggacttctttcagaggagtaactggccaagttgcctcccctgatgtagcaaagataaaataaataaataagttagtagataaccacagagttttaatctcagtcccagaaagttaacatatctaattaagcttcatactgccccctctgaaaaatagagataatgatatttacctcattttttattatgatgattacataaaatttctggaataacacatgatatatagtaggcattcaataaatgttagtctcttttttcttttgatactgacataaagaggaatatggcagcttcctgttgaggcagttaccaataaaacttgcttaacaccttggataaagactctctttttattggagaaagcaatcatgccatgttttgtttcgtgctaaggtaaaaatcaatcaactgtagaatatgccttccttgaagaaaacttgggaacttttctattttttttttctatgctaaagtaaaaaaaaaaaaaaaagaaaagaaaagttacaattaacagcctccttaagaaaagtacatctatctgaccttcatagttggatggcactttctaaagaatgactttactggttactgtctcattctttcctctatacatacttcccagatccaatgaattactcaaaattagattaatcagtcataaaaaatgtcccaaatgactagtcagcatgaggaatatttctttttctttgagatggagtctcactctgtcacccaggctggagtgcagtggtgcaatcttggctcactgcaacctccatctcctgggttcaagcgattctcctgcctcagcctcctgagtagctgggactacaggtgcctgccaccatgcctggctaatttctgtatttttagtagagatggagtttcaccatattggccaggcttgtcttgaactcctgaccttgtgatccacccacctcggcctcccaaagtgctgggattacaggcatgagccactgcacctgcccacgaggaatatttctaatatgaaacatgtcacgtccctaggcagaagtaagtttttgagctgcttatctagttttgccctctttgggttccagaaactagactcaaattcaggtgtagtgaattgattttagacttctgcctaaaacactacataatagttctgtaacttgggacttctaaaggcaacgcaaaagttttttgagaatgacttatccatgcactagaattagaattctatatttaattgtatacaaaatatattaatttgtaaaatgctatattaaccatatgagtgaggcactgtgctcagtactgaggacccgtttgtgtgcaaaagagacaaactccctatcatcagggtgcttctagtcaagtagagaagacagaccttaatgatacagtcaatcaaactccccctaccacaaaatagattataaatacagtaagtgctacagagagaaatgagtttcctcaatgtctcacagcacacacagacacccaccatttcaaattctctgaattatggaagtgatgaaaaactttagctcaggctaagtaaagaaaaaatattaaaggatcagggatatgaacactagacacagaattctgattctgtatcaccctgtgatcccagttcaacatccatgagatccaaatccagagaggtaaagaaagaaggaaaggcagaaagatggcttattagttaaatagatggaaagcaagcatgatgttgttagtcaccagtcaacaccttgtgctctggacagatctgttgctcaaatatcaaagaggaaacccacaacagccccttgtcagttctgtatccccatattagttttaatagatcagttttttataatctatcttatatcttccttctcattgtatacctgaaatgacctaaccagcagctgagagcacatacatcttattctcagagattctaaacagcaacttcctttatccaaaatatacaggaatgtaggagcttggtaaggagctcttgttcagcccaatttacagaacatcaggcatctctccctgaagagacacttggaacagggtttgaaaaatgcagcagtctagaaactagtaactacaggaatattaatactgcaaaactaacaatctaagcatgagtaccagctgtgaatgaggagtcacatcatttttaggggtccagaaaatcagtagatcatccattctgctattagacttatggggaacacattagtgaagtaatagaatgaaagtggacaatatagttttggcagctcactttccctctttaaaaaaagaaaaacttgtcttttcaatatatgtcagttcaagttttgaaaagatggattatacaagagaaccacagacttacgaatcaagtataaaagggaagaaaaattaaaagtgaatagatacctaaatagatgttattagaaaatggaccgcagttttctaatccatgtttcatctgcatttctagaaaataatataatactgtgcattttctgagaaccagagaaatggcaatatgcttgttaggaaggaatttcactgacatgatcaagattatttaatttaaaatataataacatatgctaaattgattaaattcataataaaactatacattatatgcgctttagactcttaggtaacctctacatacacttccagtaacttaccattacagtaaggatgaaacagggataaaaaatacaaccattgatggaaaaaatgcccagtgattagaagaaaataaggaagttaggaacaataactacacagatatttgtacaactgtgtacatagtaagggtagttatcactgagaatttaaatttatatcataatgaggttagcattatttcaagattctgagatttggtagaccttgtttcatgttagaaagtataatatcccttattcaaaagaaataaatctaatactagtgaagggaaaaaaacatataattatctaatgtcagaagagatatctgtgaacctgaagcttgaagctttgtgcaagctatttgggtaagaattttaaaaagtaaaacagaactgatattgttagaggagactgtggtgggccatccaattaatactttcctttggcttctgatacacttccttccttctgtctgatgttacatcttctctgacatattctctccctctctcattcattagtattggtgttacaccagactgctaggctctgctctcatccacatctaagaatttcctcattggttgtgtttatttccatgtctcttattttcagcttctataaaaagatgattcctaaagctgtaacttccacactgatagcttttcaaagctcactaggtcagacccagtacaaacagcatgctcaaactggagctagatatcattcccatgaaatgtgaccctttgcttcctaagccctcatcttagttaacagtattgctatcagctacaaagcctttcttcttgattcttctatcttcttcataatttctttcaattccagttctgaaatgtctttaccaactaattgttttctctagtacagttacttagtttttgtctttatcatccctgtctccttgtgatagtcttctgactggtttcttcatttccagtcttcacttgccatcacagcctcctgccttttcaatctatctccccacaccaccaccagtcctgcccttgagatgatatattttataaaaagccttaagtaaggttaggatgattacatcttggagttatcatataaggcatttgcacgatgggtaagaatttggcttgataatctctaaggttaaattgcaccaaagactaatatagcataactgaagttgcttattcaaaataaagattcctttgccccaccacaatgtactgactcaaaatcttctgagtttagactcctgagttacagttttgtaggcttcccaagtgattgtgatacgcatccattttttggaaactctaagatcttattcaattataagattcagtgattataaccctttaatcagagtccagtttgctattcttagagaatagttacaacagtattttttgcaatgaaggcatcaaactaaatgtaagactttctaaatggtttacattaaataaaagaagcattcatttaatatataaatcctgaaagatttgggaaaataattacatcacattagagacaagcctcatgtacatttttaacacatatatctaatgagttttctttagtttcacacagatgttaataagctgaacatgaagagttcaaaaatatatctgataaaaatagtagtaaatgttattctatgcaaagtatttagaaattaaacttaattacattaagatgaaaacaattaagatttagcagaacagtaggaaaaactggggtaaaattaagtgtttaattactttttccagctcattcttttaggtaatgaaaagattcctgccctatatacaaacataacgtttcctatataagtaaattgctatggacgttagcagcacatgacctagcagtagaaacagacctctatatatttaataaattttattgtcaaatcattgctataaatgaactaatataaaataataaatataggaatgggataggtacagtggctcatgcctgtaatcccagcactttgagaggccgaggaaggtggatcactcagggcaaggagttcgaccagcctggccaacatggtgaaatcccgtctctactaaatatacaaaaaaattagccgggagtgcctgtaatcccagctcaggcggctgaggcacaagaatcgcttgaactcgggaggcagaggttgcagtgagccaagatcacaccactgcactctagcctgggtgacaaagggcgactatgtctcaaaaaaaaaaaaaaaaaaaaaaaaaatatatatatatatatatatattattaatactttttttggtaaaacagcctctccaaggagcaaatttgtaaatataagcctaaactctatggcatactaaagtatcagaggttgaattccaactatataggaagcacatgggaacgtagatgactagaaatacagatataggtatattaattagcaatgagatatgtatttttatacttaatgaggtcatataacacaactgttttgtatttagttatatttagtctgagctatccacaattttttaaaatttaaagccctttgtttcaatattaaatgcacaattatttagagtaagaatacattttcccatagaaacattttacaaagtgtgctgagaatcccaggctagctcataactcctattaaatccattatgactttaattatagtactaatagtactatctgaaatgtgagatcttaaagcaaaacagcagcagggcagaaataaggggaagaataattcccttcccttccctttccccttccccttctctttcctttgtttcttcccttcccttcttcccttccctttctacaacgaagctacccttaggcatattttgaaagaactacatgcttccttgctgtcattacttgttgttgcctcccctacctcccagtaaccattgatattcaaagccactgactgcaacacccttgatcatgggataggacaagttaataggaaaactttactccttatcaatgaggatttgttttccctgcatatatcaagaaaataaataaatgaaaggagcttaaacaaagaagatgtggatatgcatagtccacaggtagtggggggtccatggttctcagggagtggagccccctctatttttctcttccaaacccagaacacattttctgtccttcaagttaccttgaagtccaaaacaactgctggagctgtagccatcatgtttatgtgccaggcagcagaagaagaaagtaaagaagggaaaaaggttactttctaccatgagtcattttcctttcaggaatcctctgtgtacatgttattggctgaaacctattcctatgccacatttcacagcaatggttgatgaaaaatgtagtattgtaactaatgcctttaccatcccaaatgaaattagaggtctattgctgagaatgaaggggagaatagatattgacatgcaattagtcatttctgctacattcctcaaatgcccaatgctccagattacttgcctcctttcctacttactcagtgaagctatctcaagtccattttctttcaagtctaactgacaggaatgatcctcctagaacaatggttctcaactttggttgcacattagaagcacttgcagtattgttaaaaaatcctgatgcccatgtcacactcagacaaattaagtcagaagctcaaccaatgggacacccaggtctcaggattttatatatgtgtgtaaatatgtatatatatagtcttggtgattctagtgtgtagccaactttgagaaccactgtcctaaaaaattgtaaaagacagataatccaaatgatgctatattctgtcactatttttctgctatataatcaaggaataatttaaaaactccatatcataaataaagaataaggaacgattttgagagtggtgcacttcccttgcctgccaattgtttgcctttggggtcagttttcttataaaaatgaacttcctcctttttttaacagaatcttctaaaacatctagaccacaagattctctgaaaattccaactcttctttactagtgttggtcatatttcatatctttttcacttttcacacactcccacatccattcaaacactctatatggctctaaaataagtcttaaatgtgtgcacacctttatctcatccaaaacccacacagaaaccaaagaaatgtttaaaacacacacgcacacacaaatctgagcttgtcattgctctacaaagatccttagaataacttcctactgatctaggattctctaacctgcaagatccccttcctccctacctcccagcctcatcttaggccacttgttacactgtcatacagtggcttcccttcatgcctctcttccttacagttaatgtactttaactgtaagtttgccaagcccatgaaatccccaactccatcaaaccaacacatttatttgctcattcctattgtaggaggcctttgctgcttcaagagactgcttagaacccatgttatacctcttcatgacccttatcacagttacagttgtttaaaaggccactgatttttttttatgagagcaggaaacatgttctgcattattttgtttcagaacctagaatagttcctatcacagaccatgtacatgttcagtaatatcatcattaacgttttctgaatgaatacatgaaacaataagtagcaggagattctgaaattagaaaggtagatggggaacaaactgaaatggtcataaacagctgcttgtaacttagggatatgtgacccaagtcaacatctctccctcctttacaatatgtgtttgtgtctctgcaggttgtgacttgatcccagtacagtatcttcgatggggtgaccctgaacccattgcagctgtggtgtttgcctgccttggcctcctggccaccctgtttgttactgtagtcttcatcatttaccgtgatacaccagtagtcaagtcctcaagcagggaactctgctacattatccttgctggcatctgcctgggctacttatgtaccttctgcctcattgcgaagcccaaacagatttactgctaccttcagagaattggcattggtctctccccagccatgagctactcagcccttgtaacaaagaccaaccgtattgcaaggatcctggctggcagcaagaagaagatctgtaccaaaaagcccagattcatgagtgcctgtgcccagctagtgattgctttcattctcatatgcatccagttgggcatcatcgttgccctctttataatggagcctcctgacataatgcatgactacccaagcattcgagaagtctacctgatctgtaacaccaccaacctaggagttgtcactccacttggatacaatggattgttgattttgagctgcaccttctatgcgttcaagaccagaaatgttccagctaacttcaacgaggccaagtatatcgccttcacaatgtacacgacctgcattatatggctagcttttgtgccaatctactttggcagcaactacaaaatcatcaccatgtgtttctcggtcagcctcagtgccacagtggccctaggctgcatgtttgtgccgaaggtgtacatcatcctggccaaaccagagagaaacgtgcgcagcgccttcaccacatctaccgtggtgcgcatgcatgtaggggatggcaagtcatcctccgcagccagcagatccagcagcctagtcaacctgtggaagagaaggggctcctctggggaaaccttaaggtaaaagttgtgggggcttacagggatgctggcccctaaaactggagcagaggcatgtgtttcctgggtcttttaaatgggagaaatctgggtaaatgaaaccatgtgaggcagggtgacttacggcatggaccttctcataaaatggtatttatggggttaatgggatgtgggtccaattacttaggccaagtctagaaacatggaagtcaaaatctctaataaagcagagttacagcgtagggggagtgaggttgagagggcagacagagcagagttagctcacaaagccaaggcaaggaccctcaagttctgaggggacagagttatactgtgggttaaattctagttcaccagaacagagtaaaaatatattactaacaaagattatactgagagcaaaatgccaagaactcgacacatcagactgcacttgtacgtgcctaaaccttattcaagccagaagagtgcttaaatgcccatccaatagaggcacaagaatgtaggatttatattttagttcttaatgggcaagatgaaatctttaggagatgtctaagcagctgaaaagggcaaaacaacaaagtgactttgcacataaaaacaaccagtcattttcccaattctttgttgcctatagtctcatcccaccccaagttcaatatcacaggtagtagttattcgaccatttcaatctgaaaagaatctaaagccagaagccaatgatttcccccatataaggaacttccttatgtgataaatgatcccaaagcacttcaaaagacaagatcatgttatcagtggcttgggaaaaatgttgaagtatgaaaaaggcaacaccaattgttgataactgggactaagtatcacctctatttaagaagtgtaatgtgtaatcaaaagagctggtcaagacatcagccctgctaactcttctgaaatttaacagtatttctaaaatctagataaataaatggaagatatgtagatttcaaatggaagctacatatctaaataacatctcttgaactattctcctatactatcacttagcctgcaggaaagtcctacttttctgtcagccctaaatcttcaaagtatgacttattatgatggtaaagatactatgtctgctgaagtttgaaaataaatcagaggatagttgaattttatccacaaggtccaattcgtttacattattaacttgtactcttacctctttcaactcttttctacttgttttacacttctcatctctttctacgtacattgtacaagacattcaattaaactgtaactcatgtcttctttttcaataaatcctggcaatgtcatggtctgtacacagcaggcctttcatatatctaacctgctggcctattttccatctgccttcctgactcctgtatgaaccattctttttctgaaatttctgcaagatcagcctttccttttggctaagaaaatttatttttcaaacttttgttttatcagcttttcttcaagtcctatctgtaaacagaatctcccaggaaagcctggtatataaaacaagcatattgatggaggaagggaattgtgagtctatgtctgagcacgtaaaaaactcactagagaaagccccttagggagacagcatggagtggtggcagagaacactggctgcctagccagattgttttgggtttgaacaacagcagtgctactttgtctctctgcaccttatttctatcatctgacaaactggattgtaaaaaatgaaggagataatatgtgtaatggctggcacatagtaggcactttattgaaggtagcacagtatagtgctggagagcactgggattaaatactggcagcatcacttagcaggtgcagaaccttaggcaaattcacttaacctctctatgctttgatttcttcctccgaaaaaatggagataaagaaatgcatacttcatagactggttgtgatgactgaataagttaacatgtgtatagtgtctgccacatagtaagcccttcttaagtatttgctattttgattaactaagttaaccattgtcagtcttcttttactcatgaaagttactgtacccaatacacaatctggatgatcttaataacaaagacagcactataaacggcagcacaaacctatggagacattgattatacaatctgagttttacagggcatctcgatcttcatgttgtccagctctttgccattctgtatagcacatcctgtcttccaatttaagcagagcaagctccttagggatggaggccttctttaccttgctcatcactgtgcctccaatacctacctgtaccttgaagggtgcttgacacatagaatatgctcaataatgatttttggtatgtttgttgaatgaatttgggatggtattaatgtggtaggtactttttttgcttgtcttcaaatgtgcacactcttactccctagttgtactattaacttttataagattaaggcaacagtgccctgtattacagatatctctctcactcctgtggtcatcagtctctgctctagaatcggatcactgatcccttgctttactatagttataaagtttctctagtaacattcaataaatattttcaactgttttgtttctaatttaataaacaaagggacaaacaaaagcaacaaattttactgatagtgccaaccactagaaaacggaaattctaaagatttttgttgcaatattttaacttgtttttcctacagggccatgtagtttttttgaaatctgtgcatttggatgttagaatctgaaagagggtaaagagaaacctttggcaagtgtttggtcttctttctgcaatcttggcaaatcttgatctgtctatgtgattatagctgacacaggccacagtctgattatatggagatttcttttttgacatcaactggcatattcaagctagaacctgcttttgatatggataagaaaaaggggcagggaaagctataattcttttgtatcacatgcatctgatatctgctctcctttttaacccacagtcattagaaagagatgcaaactaaaattcctttcctctatggcttccatgagctccaaaactaaatatttcttctctgtgatacaaaatctgtgatgtttagcatatttattacactataggatatagctggttatgcagggattcagctcccatttgataattacttttatgaaaagccagtgtataacacatggttcaccgcacttcagcttaactaatgggaaacaaataaattcaggtatttctaatatttttacattttcttctaaattgcttccctgagttgtgcttctcagtcttgaaaattttaatatgctattgagcccatctcttgggatgtcatgtgggcttaaataggtaaatcaagtctctggatgtaggtctttggtggagaagcatctaccatgctcgacccagccctgttctgctgtcctctgtcaggtgtatgaagaaacaggctgctataatctgagattgggtatgccctctgtttctggatggggtcgtgtgtgtcccttccacatggaatggcagatggtaagggctctctatcttaaagaggatactaattgtgtacctcaaaatgaagactataataatatctaagattatggtaactatgtctccaaaagtttgtacaggctcctggaaaggtgtatgtacacagatggaaaatgcaaaggcagcatactagtttagagttctggctttggaaccacacctggatttcaattcagctatgaatttgaataaggcactttagtctgttttctcaactgtaaaatggtagataataattcctattttgagtagtaaatgaggtaatatgcattaagtgtttagtaccagcacgtagaaagtattcaataaatgctacctcaaccttttagaattgtgtctgcaagtagcagaaagcctgttttcaaacacttatactctttagagttcattttcctcatgttataaaaattgtggagggagatttcttcgggtgttggttcagtgatgcaaaggcaaacacttctaccattctctaggccttttactaatggttgtaatatagttgtcatggttccatacattgtgtactttcattagggaaaacaaaagtcttctcagagtcccataagaattgcccttgtgtctcactggcccaaactgtctaatataagagaatatgggaaagtgacatttagcctcttccatctctatcatggaaatggaaagaaaaaatggcgtgtcaggtgtttgttagataatccagtgcatagtgcctaaaatgttagcacctagtagtagtcacggtggtagcagtcgcagaaggaagaggaatggaacagagaagagagcaaagaagaggaaagaagtaagaagaagtggagcacaaagtaggagactggaaaaaagtttcaaatcagagtagtcccccaaaatggttcatttattacctacctactatgttctgccaccttacagaactttttgtatgtataactagtctaacatttctaattgtcataaaatactgcaagttgaagcaacaatcctcccatttttcagatgggaaatttgaggtcctgcacggtgagaatacttgcctattgtttcatgactaatgagtaatggagcagtttttaaattaaggtcttagctgatgattactagagctaagcatatatggactgttttctttggaaaattagtatattctttgaaaaattaaatagctccatgaaaaagaaattatttggtcaaaaaggtgaaaaaactctattctcttattggagataaacactgagaagtcttgcactgtagaaacctatcatctatttgttaactctttctatcattttgcaaacatgtatacaagaccatttttttccaagtaaacctcttaacattctgaagaactgatgctccaaagaacttactttggaaaacatcatcatagacccaagagaagacatgtttatggggcctgaagagtagttcatatctttagtgagaagggggctagacgaagcaaatttccacctctcatcatggagaaagaatcactttgagctctctgagcacctaaggagacaacagaggtaattctaacagatccaacaattttctgtgaagttaaattggctcaacctagagcacaaatagaaaagggcccggaatcagccattcaattcactgaaatagcaaagggagatttttatttaaatggaaatgagtcactacagatttttttatatggaaacatgctatttatgccatcaatgtatagaggtccctgtgattaacattttggttctagacactaatttccagcacaacatggtgcagcatcaaatcattgtcaagcagataatgccaggcttccgtttaaggcattcacttcagctgcaaattgacaaatgaacacaaggccagttctgacctaaataaagcattgaatctgatgaatctaaagttctagctctgcaagattcagaatttccaggcacatggaactggggttctaaaatgcaatgggcctttcatggctaaattgatgacagagacctacagctggaagttataaattttctcagaagtcaaaaccctcccctgggattctagtcagggggcagaatcattagtgttgcctccaccttaactgaaatttagaaactgccatttgccacttctgttttaattaactaattaactttgctttaattagcattgtcacgagggcccactttggctgtctgctaaagcaactgctggtctccccacattcattggccgaattacaatatgcctagaaaactggttcatttgtgtgaattccaatatactccaattgttgtcagagctttcataatttccaatggcttatatttccttcaggcattattagtctgcatgaagtgatgttcatgctatttctcgttctttagagtcctccaccttttccttctatctctccagatcctactcatcttccaaggctaggacacctcaatgagaccctatcagatttacccatctcacagattttcccacatctggactcttggagcatttattatgtattccatatatttcacacatatcactctccctttcttcacttgttatttattcacagacattgactgaggactgagcaataccaccactgtgctaggccctcgggatattgagtttgttttgtgtacatatgtaacattttcacaactatctaatgctgtcttcagcgtatttatatctcccttggtgcctagcacagtgcttgccatgcagtgattaataaagagcacacagaaggacaggtggattagagatctgttgggcagcacctcatggagctcacactgccttcagagtgaacaagattactcactttgctgacttgatgggccagattttatctgataatgctttgtcctaaaaatataagaaaaaaaatgctttctttctaaaatcaacttttctttttaaaatcaagcttccattgaatgcctactcagcagcatcagtaactgttccagatcctagggatacagagatagataaaaaacaatctttgggaagccctcagtctcccaggaaaggcaggattagaaacagttaagttcaataaagcaatacagtgccatgataggagcctatagagaaacagaaggacccaaaggtagaagtagtaaattctgcccgaaattagaaataatgtttaaaagatactcattcaaacaagaaaaactatctaagtgttttaaaccctgtttagaagccttcagggcttctccgcccagtaggacaggatagagccataaagttcttttgcataataggaaaggcccttgctaatctgactccttcacccttagctagccttgcttctggccaccccctgcctgactttccacactgatccttatacaatttccttgctctatggcctctagagaggcagctactttggtatgaaatacacctaccccatctcaccctcaactctcacttggccaactcatactcatcttagataccaattctgctggaaagcctctcctggccctctgagactgcattaagttcccctccttatgatccaaatgagccatgtgcttctcactacagagcatttatcatcccacgttagaattgtctgtttaattgaaagactcttttgcaccatcatctctagactcgccacagacacacactataccatgaacttattaaagagaggagcttactcattttctgtatcatttgcaccgtgcacagtgccaatcacatactcaatactcaaaaatgtttgttaaatgaatacatggataaataactaatgtctgagctgcactggcatttgccagtgaacaagaaaaggctgaagctagggagtaatagttattgagcacttgctatgggccaggcactgctctaaaccccttaaatgtaatgaatctttttatatccacaacaatctatggggtaggcattattagctcatttattgtacacatgaggaaactgaggcaaacagaagctaattgacttccccattcagatagtaagtagaagaggaaggattagaataaaaggaagctagcttcatagcccactcaggtaacctttaagctgtgttccttattccagcccttatgacaaacatggcagccctaactgaggaaaaactgagattaatgagtgaggagtagaactccccgccaaggaatttccttgaaaactgctccctgcatctttattgcactgcacacttctgattccatcatatcctgaatgaaccaaatttgattgtgaatagagtacacaaaagcttctgagataaaatttaaaccttaagaactgcctgaaatttggtggtgattttcaaatatttgtatagattttctttatgagaataaaatctgactgacttatttttattatgtataatatttttacaggaattgagaagacttacactactttttggtataatatttttagttacaaagtttttattataaacttttattatgagctctttataaaccacatttttactctgcttctatttactaatttttccctccaagaagtcccacaaacttaaaaaaatagaactttataaatatactttgagaattatgctgttttgtgtttgtgttgtttgttgtattttttttttttttttttttttttttgagatggagtctcactctgttgccaggctgtagtgcagaggtatgatctgggctcactgcaacctccacctctcagtttcaagcgattctcctgcctcagcctcccaagttgtgggactataagcgcgcaccaccacacccagctaatttttggatttttagaagagatggggtttcaccatgttgtccaggatggtctcgatctcttgacctcatgatccacctgccagcaggtcaatgtttcaagtcatctaaccctttcccactctctccccttagaacaaaattacaggagtgcagcctgtgaaatctcaacagcagaaattgcaacccttttccaaatcccacctatcccttagcacaatggcattcaacaggtgcttactttggataataacaattaatgaggaactgcagaaacactgactggaatgacagctcccaaaagcagtgagaacaacaagctgggattgttgtttcgaatgtggggctgtatttacaaactcacctggccataaatcgccaagagctgagtcacaaaccctgatatagttacttttctttggagagagtgcctaatctgaagtgaaatgaaataggcaaaggatccttatgcttcccaccttggttcagtccagtgtaattcaaccagagtttttagaataatcattatatactgggtacattgctgagttctgggagaataaagataaacaagacacaaagcctgccctttggaaaagctcacagagtagtgggggagatcaattcatacacaaagcaatgttttagagtatgaagtgatgagagagaaaaatgcacagagaaatcagaagtcactgaagaataaactaagtccaatttgaaggtttcaggaaaggtgacacttgagttgaatctcaaagggatagcattaggagaaatacctaatgtaggtgatgggttgaggggtgaagcaaaccaccatggcacgtgtatacctatgtaacaaacctacatgttctgcacatgtaccccagaacttaaagtattaaaaaaaaaaaaaaaaggatgattaagccacgtgaaaaccgtggaatacaccatactgggaaacaacaggagcaacagcccagaagtatgaaacaacatggtgtgtgcagggaatcacaagcatgtaaaatgtgtgtcagcaggtaacaggagatgaagctgacagggaaggggcagaggaggatcctctattgtttccttataagcttagcctcaaggagccatcagccaaccaccttccagctttcccaatttcctttcagttgcctcttttcccttcttaacacccactttagacatccaattccataatactcatggctacctccccagcatcagcctgatgcctccacacaccatatgcaatcaaaacttcccctcctctctgctagagaagagataaattaatctgtgctatgatgataaggattaataatggcttgcttcatcctttatgcagtaaacacttaatgagcaactactttatgacagatactgtgctaagtacttttatctgttatctcattggatcttcacatagtattttaaaatagaaactatcatcgcctatccacatataaagaaaaattagtaacggaagcacatagaggcctaatagcctttagttagtgaactaataggtggtagaaccaaaatttaggattcaaacgcaggtctatgtatcttcaaagctctttttcattccaacattgctttactggtggatttattttctcaagcatgtatctcattttgttcttgttactgttgataaataaggtcatgatgaatgtatttctgccacatattttgacacagatttttagtcccagagaaataaccctaaatgcaacattttttttctttttttggtatataggcaaatcagtccaagtgaccctgatggaacaaggtagccgtcggtgtctctcatgtcataatttgacagaagtagtgtggtatagggaagtgagccttgtcagcgaagacatgcattctaatcctgactttgacatttataagccaggaccctagactaagcacttaaattctcagagcctctagaaaataaggacaaaaatattcatttcactctgtattgtgctcaaaggtccactgtgaacataatacaggatgtatcccacagggccatgcatggtggctcatgcctgtaatcccagaactttgggaggctaaggcaggcggatcatgaggtcaggagtttaagaccagcctgaccaacatggtgaaaccctgtctctaccaaaaatataaaaattagcggggcatgatggtgggcacctgtaatcccagctacttgggagactgaggcaggagaattgcttaaacccagaaggtggagattgcagtgagccaagattgcgccattgcactccagcctaggtgacagagcaagactccatctaaaaaaaaaaaaaaaaagaaaagaaaagaatgtgtcccacagttcatatccatgaaatgtgagttttcttttcactaatcctggggtcatctcatgaccccacctaatagacagtcctggtgacaatctgagtaggttacatgactttactctttagaatgctactgacatggaaatatttgacttcaggaatcctgcctgaactactaggaaatcattgctctatcctggggatccatggccctccaaattttcattacatccttcggtggcaagttaataagtttctgcttaactgcttttctagaagtcaaactttcctcagggtttaaaggcggtttgtgagttttagccatttccctcattcctgttgtggtttggcagtgcatttatgattcttcataaaaaatatgagttttaacttggcccagaacatgtggatccatctttacttaattacatagaaactaaatgataaatcactgcaataaattttatgcatcatataatatgaagctgtatttggtgaggtatgtgtgcgcttatgtttttcatgtatatttagtcaaaaaatttaaaaaagcaactgaagaaaatagtcacagcatctctcaggtgcataagctttgtgcctagccttgctctgtggcatcacgacagcacattctggataaagaagttgccagagtgcgtgactccccctctgctgagttaaaacggcacagccagaaatacaaactaataatgctgtttctttcatttatttatgtgactttttagtttgagaaaaaagagagaccacaacttggtaaacaaacataaatctgtcattggccatgttcttccaaaacaaacagtaactgaaaagcaaaaagcatggtgaatataatgaggctcccagtgaaaagaataattacaatcagcatttgttaagtaagtcccagtccagtcgcgtgagactcttttccatgtgttttgcgtactactattttatggggtaagacttcccaacccagagtttctgattcagtttgtctggagtagggccagagagattgctttgctaaggaacttccaagtaatgatgacattcctgggttaggaatcacaacatagattcactttgagaacaatggacttacatattctaagctcacaccagtgatatgagtcagatattattaactctgttttaaaagtgagaaacttgaagctgagggaggttaagtgatctaagattacatagctggtaagggacacaaatggtcctgacatccaaggttgtctgagtccaaacagcatgttctttccacagtaccatgactggtaagctttcaagaggatatgtcaagtgggtaattgttccctccttcctgtttgctccatattcaaacttttgttttgcagattcattaaactctaggacattgctggcccacctgagggtaagataataacactgccattataagaggcttgctattggttattaagcatactctccactctgcccatctggtaaattccatagcagtctcagagattatgtgaaaagtcttcatccaccttctccacttctggttgaggggaacactttttcacctcactaggagccaatgtccaatccaaaagattatttgcccttcccctacattcaggtccaaacaaacaactgcatcagtgccagatgcaggaacatagttaattaacagggaattagaaaagaacttgggatataagttggctagtatctcagcatcatcatgtagaattgctgtaaaaacaaaagctaaattaaacaaaaaaatcttattacatcttcaatagcatgaataaaacaagggaagtaataggatagaataatatcaacctggaagtcctctttagtagccagatgatggcccccaaacatggtcacatgctattccctggaacctgtgactatgttatcttacatggcaaaagggacttgcaggtgcaattatgttaaggaaagatgatcctggattatccagtgggcccaatgtgatcacaaagatattacaagagggaagcggggtgccagagtcggagagacatttgaaagtgctattctgctggctttgaatgtggaggaagggtatagaagccaaggaatgcaagcagcctctagaagccgaaaaatacaaggaaatggattgtcccctacagcctccagaaaggaatgtagccctactgacaccatgattttaactcagtggaagccatttcagccttctgatctccagaactgtaagatattaaatttcttttgctttaaagccactaaatttgtggtcaacttttaaagcagcaatagaaaactaatacacccttcataagatctggatcccagatgaatgatcctttcctaaccacaacactccttaaaaggtagactatcttggattaggcaaaaggagaggagattttggtcttccctacccaaaactcctgtgaggttttatgacatcttacaaggttttactttggtcatacgtatcacacagaaagtcactgtatttttccccccaacatgcatgttctaccagagatcattgaggacaagaatatattcatccctaggttggctctgagtagatactcagtaaatcactgtcgtggtaatacaaggtgtgaaaatgagagcaagttctaccaattccccctacttatattcctcagggataaacaagctcctgctgtgctataccatccatcttaattttcccctatgctgtggcctgttcacttttactctggatcccactggagtcttgattagaagctaaagagagcaggaccacacttggcccattagtgagagtcaggcacaccagacattgtgctctgactcaggcagacacattatgacaatgcagaaaaggcacagaaggaacatcagaggaaaatgagggggaacaggaactctgagtgaactgtggacacatctctcaggaactatctagccactggatacagctgagtgtacggcttattgctggagaatggaccaggacaaaagtagacttttctcatccatgcacagagctacggcctgccagcatagcaaaatgagaaccaaatgttctagcccaaatggactagcaagcacttttccctttgattgattaactaataaaaacacaagaaaaattgatttcatcattcactcacaacagaagtccaacttcaggacttgtcttaatctaaagaatgtttaaaatgtccgatggtacttgagaaaaactgagcaaattgactttagtgaaaaactttaaaaaacaacaaaaaaagacatgttagcagaatgctaatgtgatgaactggagctaagcagttgcagacttctgatgtcttggctgtctttttcaccttcaaactccaaatccctacatcaaagcacatgttatctaatttccccttggaaatttttagaggcttttgtttaattgcattcactgtacagacactgctctgtgactgtatctccagggagaatagtgccagacagactacgagttatgggctgagaggagcagacagcttttaaactctggggcatttctgaccatcctcagtaatgctagagaagaatcagaccttgtgtgtcaacagtctatggactgtttttcctcctccttttcttctcccctcaacccctaacctggtccccagcagtcagtcgaccaggtccctttcctggccagtaggtggcaggcgaagttctttgggcaactccagtgagaaagcctttctgcccaagatgcactcagcttgtgtagcaataatcaaagactaccactgtgggtttgcacagagagctcaatgtaagcagcagagacaaacttttgcagaagcagtggtaagagtagaggtgctgattcccagatggaccagctgaagaagattcctaatacaaatttctaaatttcatctcttggtttgctgattatcattgatatcacatttccataaccataaaaatgatataacagtccagccacgatggcttatgcttataatcctagaatgttgggaggccagtgggaaagaatcacttgaggccaggagttcaagaccagcctggatgacatagcaagaccccatcgctacaaaaaaattaaacaaaatagctagatgtggtgacagacagctatcataccagttactcaggaggctgaggtgggagaatcacttgagcccaggagtttgaggcaacagtgagctatggtcatgccactgcactccagcctgggcaacaaagatcctgactcaaaaaaaaaaaaagatgtgacatttaaaagttggaaaaaatgagctgtagctgtttcctagaatgttgatgctagattttaaaaacatacacctcacacaccatagaagaaggcttgcctaaatatcttcctaccagtcacttttgacagtgaaaatacctttacaattcaatgagttctgcttccagtgttaattcttcagagtcaaactaccatgatcttccattgattggtgatgtaccatgtgcccatgtgtactctctgtttaatctaattcacttcttacaataaccctgtaagaaaagtttattagacccctatactgatgaggacactgaagtgtggagagggaaagaagcttgcccaaggcagtgagcggctaaactaaggtttgaattcaactgttgaggttaagaattttagctctaaaatctactaaaatgtatcaatttctctaaagcttgaccttgtgaataagaatcgaatctgccttgtcacatgcttactcatcccatttctggagggggaaaaaagaattgtgaaggggcacgtagccttttactatcagggaaaattaatatgtcagagtctgcaacattttatacctaagtaagtgctcaatgcaagtatgaagaggttgaggtctgctggtgggaggtagatgagaaaagagaccaagaatgaagtcagactgtttttgcaactatcacaggatttaaagtcaagttcttggacactccagctgaagtctaaataggcagaacccacagaagggaaagtggagtgtaggatgtggaaaggggatgataggggctaatgataactaacttcaatgagcatttatgatgtagcaggtactactgtcagtaccacatagacattcactgaaccactaaaacaaccccatgagacaggtaacattactattcccattttataaataaggaaattgagacatgtgaaattgagactgacagtagcaggtactactgtcaataccacatagatattcactgaaccattaaaacaaccccatgagacaggtaacattagtatccccattttataagtaaggaagttgagacatgtgaggttaaataaattgcccaaggacaaacagctggaaaggattggactttaaattcaaatctaagcagtttgtctctagagtccattagcttagctaccagaaattataaacactaagattgtatttgaaagactggtaaagaatttgtaggaatcaatgaaatgtcagtattgagaaagacatttgggaaattatcatcattacaacttgatttcagttaggaatcttcctatttaagcctcttgataaactgaataaatgactgtccatttccctgttttctttttttatcccccccactcccttatcagtttctctttcagaagatataaagccactgtctgaagtactcatctgtattataatccagtcaacgtctgaagacaatatggtttggtcatgaaagcaaatgtacacaagaagcacatttaagtttcttagctgaaatgtctgcataatgcaagcagggctgacttgaactaaattggtacacggagttggatgtgtgtcctaaagacagattcagatgaagtacacggtttcattttatcagttttatttttatttcctttcttcaaatgaaaactacttctaaagttgttgtggaacatgtattttagaaagtggtcaggtacagttcaatttcatcagctatttcttaagcacctacctagtagaaatacttaagtcaatttttagaattaagtgtacttgacaatctggataattttaatatttaaatcagatcattagaagaaaatactattttgaccaagaaattaagtgatgattttatcatcacttctccagaccttgattgaagtttcttcttcttcttctatttcttctctggataaaagctgtaacttcaactaattgcccaaacctgtgtcatccttaacattttacttgctctgacccttcacatccaaccagtcatttctcctactaattttaccttatcttttgcattttcactgatatcttcatggatgaggtcttcataacctattgtctgaactgctgacataattttctaaatctctcttgttgatccaccaccctgtcccagcagctaccagcgtaatcttcctaaagtgaaaatgtaatcacattattcaatactcaaattgagttcagcgggtatacatgccttagaatataaaaatctaaaactctttcacatggctcacagagccttagtgacctggcccttgatgacttggccttcccaaccttggatccagccaccagtctgctacatcaagcccctagagcccccaccaccagtgccatactatacctccaaacacatactatatagccatatagtatggctatataaaatgtataccatactatatagcctccaaacacatactataacacggtgccaaactgcatatagttcccaatttcaacaatccttggacatttcttttgttgttgttgtttgttctctggggggttggggtttggtttgtttcgttttgtttgggttttttttttttttctttgagacaaggtgtggctctgtcacccaggctggagtgcagtggcataagcaacgtccatggcctgggctaaagtgatcctcccaagtaaatggaaccacaggtgcatgccaccacacctggctaatttttgtattttttgtagagaccaggtattaccatgttgcccccacttggtcttgaacccctgagctcaagaaatccaccctccctggtctcccaaattgctgggattacaggcatgagcaactgtgccaggcctcctggccatttctttggtattcttcctgcctctactaatgcctgaatttatctccctttctattacctagaaaatgccttcttactctccaattcctaacccaagtgtttcacttattttatcaactgttatttccattagattctctagatctcctataaaactcatcaggttatattgtaccattgatttgcatgtttttcccctgtgcttgactgtaaatttcttgcaggcattgctttctttgcctccaccctcagcaactaatttggtgcttgtttttagcaagttatctgataaatatgtgctgggtgaccagcaaagattcacttctctagtctctggtgaagtcttagctcctcccttaatgtgaatcaacactcaatagtagttcattttccaagagaataagtcaactttccaagtgctccactagtgcctagtaatatactttttaaatatattaatgtctctcactggagatgtagaaggtaaatgctaagaagatttagatctggcaggttgtaatgttatgaatgatatattttaaagtgttttattttgagggaagaaatgctttgtagtgattaattaaatggtttggctccgtaataattgaagtatatttgtggagctattaaagactatgtctggatgattttgatgaattgcatctaaaacactcccttcgcataatgaattgatatttttaagtgctgtgattacagtggatttttttaatttgcatgtgatgttagtggcctcatttgttactacttaaatttgattgaaatgtttttgattaattgttataaattctctgaatggtaaggtaaactaagcagttttattttcaaaattctgtctcaagaaatgttccttttatttacattagtcctgcttagaagtggtcttgctgcaccgtatctggtgcatgcaaatcatatttccttcagaacataacacttaatatgagagaaaagtatgcctcaggcataattctgtgagttaacaactctcttctcccaagcagcattcctttggtaacaaggaaagaaattaaacaagaaaaagataggaatatccttttctctagccctttggctaaaataagttttctaccttttctcaatcacctggacacacatttttggtctcaccttctatgtcccaactccttcccttccccacctcccacaaggcattttgtagatcaaatatttccattagttggtaggcatagagatatatctggtggctggttaaagaagaaaacatatttatcaagttccttcaaagtactgtgtgctatttcatattatatcttatttcattgtacaatagccttgtaaaataaaaatatgctaatttttacacttgtgaaagctgagactcagacaggtgaaataatttgagcctgtatgcccagcttgttattgagctgatgtgaacccatgactgccagcctactccttgtgctcttcatactatgccttattatagcctccattattctttagctgaaaaatatttgcctgtcagtctgaaaagatggaatcaggtatagaatttcaactctcaagtgatctattaaaggaactcatagaggagatagccttgagtacaagaataatgggagtgtttgagttgcttatatagggaaggcattccagcaagagataacggcaggcacaaagataaggtttggggctacttgaggcagtctcccatctcctaactgagggtattccctaaggtcaatctgtggtccttgagttctgtctacttttgttctcttctttggagaattcaaccatcccatcattacactttcaattctggagtattagtcttccttgagttctggttgtgagtctacaaatgacaactagatagctccactttcatacctgggatcacctcaaccttaacatatccaaactcactttcttttatatcaaataaatccatttgtaatagtttctttcttcccagttttctattaaatgcaacaaatttttctacttcccactctgaaaatgcaatcatgtttaatttttcctggtcctcaatttacccatttttaatcagatataggtaaaactgttttttaatgttttgattttgtatcctcattttaattttcacaattgctatacaattgaatatcatatatctatacatcttaattaatagaagaatgagaaaccaatacatctgaccaactaaaaaatattcaatacctccccatttttgttgaaaaatacactactggcaattcctcatagtatcttcagcttgctcttcttaccttttcaatttaaccttatgcttctcctcagcattaatcttctgcataaaccaagctccctcaccactcaaattgttcttgtacattgctgtttctacaaagtaaattcattgaatttacagaaattcatttacatgaatctcattagcatgaaatttatccccacgcatcaagcttacaccacgtacaaagtctttcttcactatctagtctacagaagttttgaacacatagggcccatattaagactttaccattcactgaaatggctatgaacatatatatgtgtatacatcttcctaaaagaaaactccatttagccaaattccaagcaaactgcaacaaaagttttaacatatataattattaaacataaagcaaagcaaaagtcattgtaatagaggacaattctggggaactttagctataatttaatatcttgactttactcattagcacattcagtaactattcattgagaatatgctgtgtgccagaaactgttctatgctttgaggataaaatgaagaacaacctaaaatctcagctctcaaagaacttcaactatagtcagagagaatgccaataaaacataaacaaatacatagtattaattgtcattaaaaaaagagaagcaagatgaggtattacagtgaaattgatttgggactaattttagatatgtttagatacagtgtcatgaacagccttctgaataagttaaagagaaggaagaatgaagcgagaaaataagacacacagagttctgggaggtggaggtatgtatcccaagcaaagacagcaacaaccaaaaagatcttaaggcaggaaacagattttcattttaggagactagcaaaaactccattgtgattaaagtaaaatgagaaaaggagagaatgacaacagaaaaatgtggactggtatttggggatcagactaggtgaggattggggatcagacaatatacaaaatatatattttgtatattgtcctgaatgtgataggaagcttcggaagctttgagaagaggagttacatcataagattaatatgttcaagatatctttctggtttctgtagatagaataaaatttagagtgacaagaagagaagagggaaatcagatgtccattgcaacaggataggtgagaaatcacgatggtttcaactagaatgtataatgatgaaacttaataactgattgaatgttgcgtataaagaaaagagaatacttaaagatgggtgctagattttacctttgtgaatggaggatttggacctgtgtaattcaacctcaaggagaagaggtttgaagggtaaaattgataactaagtttggacatgtttatattatgtcctatgagctcaaagaaaggttcagactagagaatcaaagggtgggggagggggggccaactgcatttgataataataggactaaattagaaataatttggattggggtgggtaaggtaaaagagaataggtttgaagaaatatgtgtttgtttttggaactattaaatttaaaatttctaagagacatctaagtgaacaagtccaggaaactgcaagaaaattggaccaataattaggagagtttggggtttgtttgtaagcacaatttggaagaaccaagaacagagcccagagactagataaataaagaaagtccaagaactgagacccagatacaagtgatagcatgacaggaaaaatgtgtttcaaagatgaagaagtagtcaatagttccagttgcagatgagtcaggttagatagagttaagagtcatcattgggtatggaaaccagatgttggttgagggtttagcaaaaagcaatttcaggtcccatctctttgaggaagttttttgtctcccaaaggcccaggcaaagatgtaaatcaatgttcattcgtcaaatagaacattctcattagttggctaccggattctatagtgcaaaccttaatataatgtgcaaactatcaagatgcaggtgtgatactcatagccaaggatttcgttggtaccaagagcactgagaccctgtggtagcctcttccagcctcctcttgtaatgagtttcagttcttgacagacttcttgcttgcttatgcccaagtttaatgttcctaaatcaactgcattatatagccacacattttatactggggactgtaggagcaggaaaaggagcactgaggctttgcagcactgtcatgacactcctacactaggactgtattgccaagtgcagatccaactgggccctgagaagtgtgtgatgaacaaggccccctagagggcagcagagcctcacaggagtggggagaaagcccaaaacagaggttagtggggagtttcactcaaggagacacaaggaggcaatgcacacatttacggagaatgaagttaagctttgtgaaatgaaggaagtccgtaatacaaggagtagaaaagtctaaaatgtgaaccagacagcaaacacaaggctgggctaggaaagaaaagagtgaccagaagtcagtcacaggaaagcaaggcttgtctgctcagtgaatgttatgacccaagcaatcataataaacaggtaccatttcaccattttcctagtctgttttgtgttgctataagagaataccacggactgggtaacactatttaaatgaaatttatttctcagttctgaagactgggaaatccaagaccatggcaccagcatctggggagggtcatcccatggtggaagggcaagagagcatgtgtatgtgtatgtgtatgtgtgtgtgtgagagagagagagagtgagagcaaatgggagacaaacttatctttttaccaggagccaactctcccaataactaacccactcccatgataacaacattaatccattcgtgagggcagagccctcacaaaatcacccctaaatgtcccacctcttaatactgttacacggcaattaagttttcaacacgtgaacttttggtgacattttcaagctatagcaaccatgttatctgctatgggctagatgataggttaggcactggagatataaaaatgaatacaataccatccttcccccagataacttttctcttcataataaattcagactcataaaaaataatgttagtaaggaagtatagataactcgatcctttgtgggtatacaaaaagggaaataatgatgagagaggacaggaaaggcctcaaaaaaaaaaaaaaaaggataacatgatggtatgggtcctggttgtgggttttttttttcctcttctctgatttctctatgtcttccctgaaataatatttttctttctcatttatttattctctcattcagcactttttttattattgagtcttgccaggccccactcactgttgtgggcactgggatacatacatggtccctgccttcagaaaccttctgctattttatttgtggtgaacgtgacagtcacaagcaaggcagtcagcttgcacccatttgtttcttccaatgacacattctgcaccctgccctcttcctaggcttgaaggagaaagcttaaacggtcagctctacaaggccccatgtgagaaagaaaggtaacagataaagaatatcatgtcttttcacttaatcagctcttatcgcttatgcagttaacaaatagttgttgtgcacagtgtgccaagcttgtgcctctcaggccagggtaagttcaaattacaccacggcattttccattttagttctaggagatttattttttcattctaggacacctaggtgttattaaccttttttgaaatgaagtcttgttctgtcgcccaggctggagtgcagtggcccaatctcagcttactgcaacctccacttcccgggctcaggtgattctcctgcctcagcctcctttgtagctgggattacaggtatgtgccaccatacctagctaattttgtatttttagtagagacggggtttcaccatgttggccaggctggtctcgaactcctgacctcaggtgatccaccagcctcttcctcccaaagtgctgcgagtacagacataagccaccaagcccggcaggtgttattatctttaccatgagtttagtgtgctctatttgtttgtctatgacagccaatgtttatcatccccattggattctaagctccttgagttgagaggctgtgaaatgtattttctggatgtcaagtagaaaaccaagtactatgccaggtatctagaaaatacacaatatatgtttaagtatatcatttacaaacagaagaacctagctttgaattccaacatcaacatttataaactttgtgaccaatagatctcttttaaacaggatcatcaatacccctccctagggttgtaaagagacaatgtttgaaacaatgtttaaaaagctctgagtatagtgcctgttacgtatgcttgctcttcctctttctcttctttattctttgccctctacttgatttttgtttgtttgttttttcctttttagccatgcctttggtaattttggttattttctttaatctagtgttctacaatacaagcctcagtgttcaacagcccaaatatgagtcctggctttgcctcatctaactgtgtgactttcagcaagctacccagccactctgtgcctcagttatttttatcggtgaaagggggataataatagtacatatctcatagtgtattagtctgctctcacccttctataaaggtactacatgagattgggtaatttataaaggaaagaggtttaattgactcccagttccacatggctggggaggcttcaggaaacttacaatcatggccaaatgttaagcaggtaccttcttcacaagggagcaggagagagaagagaaagctaagggggaagagcccctgtaaaacctttagatctcacaagaagtcactcactatcatgagaagagcatgggggaaactccccctcacgatccaatcacctcccttcctccacacatggggattacagatccctcccttgacatgtgagaattacaatttgagatgagatttgagtggggacagagagccaaaccatataagtgtcttagtgaaattaaatgctaaaatctacataaaacatcaatcctgtaaattacatggtatttcttccattatgcgaaaagaaaatttgagaaaaagttatataagttattcataacaatatagctagtaagtggtattgctgagaataaaatccatgttaattaactccaaatccagtacacttaatttccataatatattgcccatctcaggcaaactaaagcccagtcaagttagacaaatctgaagagctatggtatatctatctatatgtatgtttatatatgtataagtgtgtgattgtatgtgtgtatatacatgtatctgtgtctatatatttatatatgcttatatacttgtatgtatacagatgatactacttaacttcatgcattagcttatcacactctgacatgataaattcctaatatctataacagatcacaatgaaactcctagcttaggacctagcaaatactaagtacttaagaaacatcagtaaacgtttctttggatattttgcattgtgaaattaaagtaatctcactttcctttattgtgatagacactcggcagtgtggaaatctgcttggaaatgacagaattaggaaatccatctgttgtaatcatgtgtgattataattaaacataaaacgttatcctaataccaggagaaatataattacctttattaaaataataatcttaagacaatgtgatggggctgggcgcggtgactcacgcctgtaattccagcactttgggaagccgaggcgggcggatcacaaggtcaggagattgagaccatcctggctaacatggtgaaaccccatctctactaaaaatacaaaaaaaaaattaaccaggcgtggtggtgggcacctgtaatcccagctactcaggaggctgaggcaggagaatggcgtgaacccaggaggcagagcttacagtgagctgagatcacgatcacgccactgcactccagcctggatgacagagcgagactctgtctcaaaaaaataaaaataaaaaatagaaataaaaataaagacaatgtgatgaagaatagaggcagtggaaaggtaatctctagtcatagacttgtgatttgagttccctcctccccgtgtcatgaagtggagatgattcttttgatggccatgtaagtgcacaacttacactggctacctgtaattgcatgcccaggactttccagaactgcttctctctccctgggtgtcattcccactcgtgggcagctgcatctatcaaaagtaagcatgattcccctcccttcagtcttcacccctcgcatgtatataggcaaaagaaacatcccaatctccttcctccaccccatctcatcttgttcttgtgaaaatccagttattttacatcctgaaataaatggaaactaagcttcttggcaaaaatgtagaaagctttttttgtttctaagttgtccaaagacaaaggaatgaggaaaacaaagacaagttttatgcattgagataggacaggaggggttaaaagggcaagaaaggtgaaggaagaaggctagagaaagaaaggagggtggcaaacggaatgaattagttgagacaagaactggtgaatgaacttctgtgtatgatagaagggggaggctagttttgatgtagttagatttagataaatagtactgccttgcatttcataaatgtccctgcttttaccatttcacttgttgagttgctgctctatactaggccctatcctagatgcttgttaaaagaacagacgtgcccaggtagccataaactttacggtgtagtgagaaagacagttactaaactagtagtcaggcagatatttaattataatttgttaataattggtatgaaggaagagaataggccctgatacagattaacaggggagacaggctgagacaagtaaagagaagagcatcatttgtctctacatcattttcaaatccagcctaaatcgcagcagcgtaaattagggtatgtgggagcagacagatccagatggaagtaggtccagatggaggtaggtccagatggaggtaagaaaatcaaagatgcattaacttaaaagaattaatagagattatattggttatgtctcgtatgaggaagcactatttcataagtattagggggtgtgtggaggaaacaggacaaatattttgtatcagagctatctgggagaagcctgcctggttatagaagttattagtacagaagaaaatgacagatatgaaaggaacattatgaaacaactataaaatcaagcattttacatgaattgtcttacctgatcctcaatatttccattgtatatatggagaaattgtaactcagaaagcataactaaccctatgaacataaacacagtttatgattcccttatgggtcaaaggcaaactctggtaaacaagtagatccaggctttgtgagacctaaagttccttccacttggggagctttatttaagaaaaagattacaaaatgtgaatacaaaaatagaaacagggccttgccaggggcatctgtgagtgagggaccctgatactccatcagctttagagcaaatctgcttccatcgagcaccactgaggtttaagctccatcagtccccagactgagaaaatttagttgctggtgcaaattttaatcaaagttagtatcacagaggaatcagtcttcctatccaaaagggtagaaagggctcaagtaaaagcataggcagtgtctcaagccaaggagattatggggaaaaaaaatgataaggtttgaaaaatagtacagttacctgtatcccttaggccatttaaagacagaactaggtttaacaaatggcacagctactatttgtagccagcattttagtgagaagcaatttacctcacagttgaccattctagtaacctgggcaaatcacttgatctcctgtgtcctagttcttcatttgtaaagtaggaataataatagtacctaactcaaaagactgttgtaatgattaaatcagtaaattcagggacttagaattgtgtctggaacattccaagtgctcagtaagtgatggctcttattacatttattatctagcttcatctgacttcactgcatttccaattgttcatgtataaaaatgtgaggaaaaatctctgttggaaaactacctatctctctttagaaatagtaaggttatctgtctgaaaattcctcagtcctataagatagaaactagcaacttttaattaatgccataatgaaatgtttcctatggagacccttcttatagttaacattttgttcctccctgaaaagttttccctattgaggatgttgtataaagcttgtaaagcaccttaggattggttttgaaatctgtatcttcctgaatttctattgattgtgtaacaaatagtaatgttgaaggaaagtacacaataaaatggcaatgacttatgatgattcatatctgaaaacaagctctcatcataagtaggattaaaatacatcctttgggaattcttcagaagctaaatgaaaggctttactcaatacaaaatttaacacatttccataatattgctatgctgtaatttattaaactattctcccgtggttggtttgttcttttttgttgaggtttttttttttttctgttttctataacattgaaggaaaaaatctttgtgcagaaacctttgagcttatgttgaattgtttccttagaataaattcctagaattactaagtcaatacagctgattttttactttttaattccttatttgcattgcttccccacttttcagcttttacctttccattattttcacagaacacagtgaaatatgttacctggcaatttctcaaatcattttgcagcttatcttcactttgccattagtttctggagctattaatcatgctcagtttttgtttttaatctgatttatctgaaggaatcaagttgacatttcaagtctgtgcaaaagatgtttttctgcgcacggagaccacaagatctgatggaatatctagtaaatcattccaatatatttacatatatagatagatagaaggttgagagatgatattgaagaaaggaattaccttgcaatagtactgcataatattgatctttttaaatttggcttcactgtttccctctaacctaaagatccataatgacttcccttctgccttcatctagaattttcctctgatcaattagacttggaaggctgacttgggctttccttcagctctctttgtaacactctgaagttgttaaaatattctaccatctcgtccctgtctgtcttctgctatcacactgtatcccacacatcgaaactgattgtcagctcttcttagtgatgcctcttttacagccttcagatttttggtgtatttctgtctaggaaaactccagccagagaaatgccaatctgtttgcatgttaacaaggggcccagagggtgatttattccacttgaccattatgtagtcaaatttgaccttttaaaaaataagcgtatattgtgctcaaagcctagctccactaagtatacactattaacttcatgtacgaccttttcagtctctcaaatgtgccatcagattatttaaataaggggtttttaagcatgaaataaagaaaaagtaagttgttaatgaagagcatgagatttggaggtaaaacatctggtttctagtggcacttctgagacttacaagctatggggtcttgaccaaattgtgaagctttctgagccagtttccttatctgctgaatggggataattatattcctgagtttgttaagaaaattaaatgatatagggaaagtttttctataataatgtgaatgctattcaaaagtatattacaccatagtttctctcttcactttatgactgccaagatccaaaattaggatggtcccaaaaggaatgtggcaataaatctgtagaataagatgcaatgtgcagcattctacctcatatattttccctaagatgttttaaaattataaactgtgtttctgggtgatcactaaagatatcatctagaggtagatgtttgatccaaatttcacctgaggtcgaaaagctgaggtcttggctggtgttcaaggaaccaacatgggaacagaattgaatgtgctcaaagctgttataaagctttgtgttggtacaaagggggagtggatacaataactacagcaaagtcaagattaaaaactaaagtcagaaaaattctgtctcaaggcagggaggcaaagggaaagagagagctaacaaataaaaactggctccaaaatttgctataactggtctcaaagaagatggtggctggaaagaactcctaaatcatcactgagttgagccaggattacttgtatatggatctgtcactgactaataaggaataagcacataagcccactgaggttcattttcttttttgtgtgtgtgacaccttcttattcaaattacacaaaagataattgcaaacaatttttgttaaatatgtataagcccatgccaattcttcaatatatgtgaacaaaagcgttttcagagtagttataaggcttcagtactatgagctgaatcatttcccatgacctaatcagtttaagaatgtaacactaaacccacagtaactggttatgactgtaactagcatagctttcaggaaatgaacaagggtgtttcttccatgattataaggaccaattgtttaggctttctctaagtgtggattattgagaaaataatactttgttttacccaatcgatctctctcttttttgctccttacaaatctaacttattaactctcacacttattttatataaatggtacatacagaaaggagcattatttaaaagaacacaaacatctaagtaacactaaagtatttgttagtagtaacttctttagattcatcatatatatacactcacacacatgtgtacacacacagagagacacacacagtatttataaacagtcaaacctaagtaaatgctataacaatttcagaaattcttagactcagttttggaagaaaaactaatgaaaccaagtatagcagataggaggatttcagcctcagaaagtctataacctaactcaaagtggcttaaatgataacaaattaatctcacataaaaagaatttctgacactaaaaaggctaattcagtagctcaaaggacacaatggctcaaggacctacttatttcgacctttccagtctaccactgaatcactggaccacagtttttgaaatgttggcttagcttctctcatgcctgccatatggttggagcattgtcaggtatcacatccagaccactgtccacagaaaaagagactatgttttccagtgttttattaatactaaagaaatcgttctcagaagtctccagaagactctctcccatgatcattggctaaaactgatgagtaaagtggcaagtgaatctgataattactattatcatcttagtctaatcagtgtctacatcgtgaaggtaaggatgggatggcttgttaagaagaatgtgacaatgcaaaggaaaggcaaatatcttaaaaaaataagtatcttccatgtaactgtattagttcgttttcatgctgctgataaagacatacccgagactgtgcaatttacaaaagaaagaggtttaattggatttacagttccacatggctggggaagcctcacaatcatggcagaaggcaaggagaagcaagtcccatcttacaaggatggcagcaggcaaagagagaatgacagccaagcaaaacaagtttccccttatcaaaccatcagctcttgtgagacttactcactaccatgagaacagtataggggaaactgcccccatgattcaattatctcccacaaggtccctcccacaacacatgggaatcatgggagtacaagtgaagatgaaatttgtgtggggaaacagagccaaaccatattattctgccccagcccctcccaaatctcataacttcacatttcaaaaccaatcatgccttcctgacagtcccctaaagtctcaaattatttcagcattaactcaaaagtgcacagtccaaagtctcttccaagacaaggcaactcctttccacctatgtgcttgtaaaatcaaaagcaagttagttacttcctagatacaacgggtgtacaggaattgggtaaatacagccattccagatgggagaaattggccaaaacaaaggggtgacaggtcccatgtaagtccaaaatccaccagggcagtcaaatattaaacttcctttgacttcatgtctcacatccaggtcacgctactgcaagaggtgacctcccatggtcttaggcagctccacctgtgtggctttgaagagtacagcctccctctcagctgctttcacaggctggtgttgagtgtctaccgcttttccaggcacacagtgcaagtcgtcagtggatctacattctggcgtctggaggacagcagccctcttcttacagctccactaggcagtgccccagtaaggactctgtgtgaggactccaaccccacatttcccttctgcactgccctagcagaggttctccatgaaagccccactcctgcaacaaacttctgcctggacgtcagacattttcatacatcttctgaaatctaggtggttcctgaacctcaattcctgacttctgagtacccacaggctcaacaccacatggaagctgccaagacctggggcttgcatcctctgaagccacagtctgagttctatgttgacccatttcagccataactagagtggctgggatgcagggcaccaagtccctggctgcacacagctcagggacccgaggcctggcccacgaaaccactttttcctcctaagcctccagatctgtgatggaaggggctgcctgaagacctctgacgtgctctggagacattttccccattgtcttggggattaacatttggctcctcattacttatgcaaatttcctggaaatttataatttaattttcctttttgtcagtcattcatgcatacctcattcaataaatattattacctatactatcataggcactgggaagatagcagtgaagcatacggttcagaacccatgccttcatagagcttgcattctatcacagattccactgggggaaaacagagaataaataaaataaataagtaaaatataaattattttagataagttttcctgataaaagcaggaaatggtaacagaaagagtagagtggtagttgcctttttaaatagggtggtctggcaggatgtattgagaaagtgacatttaggcaaaaatttgaaagaagtaagctttgaggatatttttaatgaaagcattaaaggcagaggaaatggccaaagcaaagacactatgctgggaggatatctggtgtcttcaagcaacaagaagatcattgtagatgaagcaatgtgagcaagggagaaaaagtgacttttgggatcagagagatagtcagggagtgggaggtaagtgtagggatttgtaaaccatgataaaaaatttcataatttactcagagaaatgggtaactaacagcgttttgagcagatgaatgatatgaaaagatttctattttgacaggatattctgcttgctgggtggaggttggaatgggtttggtctgggttggggaaatttagtaacagacaaagcagaaccagtttgagaaactgttaaaattttaacaggtattggtggcttgggccagggtaataaatactggtgagaaatggtcagattttaggtatgttttgcagatggagcctgcagtatatgctgactgattacaaaaaagtctgttctttcctccttttttctacaattactttatctcaaaactctgtacattagttaccactttctgtaaacatctttaatattttccatcttccttgatctcttgaccaacatgtacagaatgtcttcagtttgtatttattattaaaaacaaaacaaataacaacagcaaatctcattggagatttgatcatccctaaagttacaattccattttattcatttattcatggaggtattccctcagaaaatgttggttgagggcttacataatggaggcactatgtttagggtttattcacatggtcatttttctttaagtctctgcacttccatgtttatgctcaagcttagtcctaaaactctgccatctttactgcaattttggtatgaaaatcccttataggattttctgtaacattcacagtgacttgtcatatgactatagttcaaatgtccctcattcaataacttttactatttttggcactttcttggccaaaaagactcttttcctcccatattgtttttctctgctcataccatacttctattctaaataataaaaagtaattgaggaaagagagaatttaaatttgctttgtaaatgggatgcatctatattggtttaaatgagaggtttccttgaagaacacactcctacccacttactccccagacttaccctcctgcctcattagtgtccattccatattgagttactaaaatttacacataagacatatgtgaaatatgcaacattttccaactcgctttcacagacttcttagagaaatcaggctgtttttttctatgaatagtttaaagcattatagcatgaagtaaaataggtatactgtggtttctacacatataagaaaatatctccctgtggttttcactaagctgaatgacagctagcttaggaatggaaaacgagtttaagtgctcacaaggcttagcacaatgctccttcaaggggaagactacgggccatagtagatgtcagtgtgagagagaaagtggcgaaagaaaattattttttaagacaattttatctattggaaagaacaaaacctggagcaggataagcctatgacaaaactggagtaagggaaatgtgcctctggtgcctttagctttcttatttgctgtgtttgtgttttttcccctccattcttgaactctctaggaaacttaggctctttctccactcatttttaaccaaatatgttctcagagagtctgcaatttctatgagaaaacatgtctctaagtatgccatgggatactcacaacagcatttgcatcttgagtgtcctcactcatacaggatggagaacatttgctccttggtatcagagaaaaatgaggaaagaattcatcaatggaatcttcctagcatctcataagttgtagcacatttgtaaattctacttctatatattgctctttgcttcatccactgacctttcccttccaaaccatatagagtccctgtctataattcctatttaatgattaaaccccccttcttattcaaccgcttcactaaacactccatttactgttgttttcttaaattgaaacccaattccctcctaaggacatttctacgccatatctctctcaagtaaagtttcttattcttccatatcacgtgtttcacaggacacagagatggaggtcagcaactcaacgctgcttccaggcatatatcacacccttacatacaaaaatgtgaaaattaaagctctgactgaatttagactcatggaatctagttatccctctatcttttagcttcatttataactactgtttactgccaacttctggataaagaacttctgtctatcccaagcccggctatcattctgagtgaatttagtgcttgtataaaggacagatgagtaccaagcttctttcttccccccagttctaatacattttaatgttcctattcctggtcacttactcaaacttgatcagcctcacataaggcatcattatttccaatatcaaaatctctccttttctgccagcttcaggcacaattctccatctatctgctacttcacctaatatacacatttattatttaaacttgtttattttcttctagtctttcacttcattctgcactcatttatgtattctgaatcacatagccaatatagaaatttcagtaatccaatattcagtagatattggtaggaaagaggaattgaggtgaagaaatgaaattttttatccaaataataatggaaaattacatttactatctgatcctaagttattcttacctgcacatcttttagatttaccagatgagtataggctcttgtagaactcagtacagaagagctagaacttcctggacaaagaaggtacaagaagaagaacaacaacaacaaaaatctttacagaagataagcaaaacttatttcagaataagtcattctgaaatttattaaatctattgtgagagtttttcatgccaagcttctggcctataaactaaagtgtcaaagctgtattaggcataaatctagaaatccatagtttataagaaaacttacaggtttacaagattgaagagccttaaactccatgtctagcatatacaaggcactcagcagattttttttccagtaaatgttttaagggaatgcttacactaacagtgttataaaagtttttggacaggtagaatgagcatggctattcacctcttctttccactgtctacatagttttcctgttctgaatattttcaaccattctcattgtatttgcaaccatcggtatgctgagagctcccctgtgtataacaatcctctaacctccaaatgtttatactcatgtgtctgctgaatatgtccacttggatgtcccaccagcatctcaaatcaaatattccaaaatgaagctttttacttccttgcccaaatatactccttctcttgaattttcttaactcagttaactgcaccatccaacacagtaactggggtatcattctatacttcttcctattatactcatcatccaataaatcctactcatttttgcctcccaaatagtcttgagactgtgctctatttttcatctgtattatcgctaccctaagcattagcttatcatctctcacatgcataactgtagtagtatttctctatctctctagttttgttccttcaagtccattgcattttatctaaatgtcaactctgatcctgttttatgtagcataaggattccacaatgacatctcataatcaacaagcaaattcatcatttttatatacttctccatctgctttcccctttgacctcctattttatacttcttacaataaaaattactaaacagtgtttcccagtatacaccatgctgctaaacctctctacatgtttgcacctgattttctcttcacggtgcatgtctgctcaatttttcagatttgtcttacgtatcatatctcactaaagtgttctctgccaatctagtatgggttaagtaacccttcttgtatttgtttctataataaaacttcttacattgtttggaaattatctgtttacatttcatcttctcattcaagactgtgaccttatcaatgacataatcacccatatgctccttatcacagtgcccagcacatggactattcagtaaacggttttgaatgatgtcaactaaacctgcctggtacaggcatagggacctaaaggaagtaacaaaatttaaagtcctatcactagattctctactgcctgtacttgataactctgctacttatttgcaaaacggggtcaagaagagaaaaggtaaataataagcttttgtaattttgtttttaaacgtagtaatattgttacttggaggaaaaattaatggaaatagcatgagctttagaatcagagaaacctgatttttaaccttgggctccctgctcataaaccacatgaggttgggcttactgacactgatcttcagtgtctgcctcttcagaatgagaataatagcagctgctttgtatggctgttttaataatttacaatagtgtacagcaaacagcctggcatgctcaatattttgtcattattactttttattataactttgaatataaatatagtaaattaaacatttcatttgaaaagtgagttaatacttgcaaagcacttgaaacagtgccttacaagtatgagtgtatgggtgttttagtatctgatatataaatttattatgtaaaagaaatgaaattttaaaattgatattccatgatctgtaaattctgaaaagcttaaactatttttaattgacaattccatatttctaaaataaactcaactggaaaaaaatgttgagtttttaaactcaacagttgagactattaaatctattagtaattttgaacagcacattactggtaaatgggataatgagtaagtgaatgaataaaaatatgatctatttaaatatctggtgaatataattacaggtacagacaggcaagtagggtcctatctgaaagcaatgatgagtttcccattctgtattaatgccattttcagcttgcattgaatacaaaaactgcttgaaagttccaaaaagtctaagatattgctcacatttttaaaatgagttttgttattattgttttgaattttcattattttgttttttatatgtcagtgaaagcttttaccaaaagcagttaggttttgtttttgttttttgttttgtttctatggtttttctaaacttttaggttcaggggtatatgtgcaggtttgttttataggtaagttgtgttttgcaggggtataatatgcagattatttcatcacccaggtaataagtatagaatctggtaggtagttttttgatcctcactctcctcccaccctccaccctcatggaggccccagtgtctatttttccctttgtgtccatgcgtactcagtgttaagctcccattgataaatgaaaacatgaagtacttggttttctgtttctccattagtttggttaggataatgccctcctgtgctattcatgtgtaaaggacatgatctcattctttttatgactgcatagtattctatgatgtatatgtaccacattttctttatccattttaccgttgatgggcatttaggttgattccatgactttgttatagtgaatagtgctgcagtgaacatatacatggatgtgtttttatgatagagagatttatattcctttaggtatatgaccagtaatgggatttctgggtcaaatggtagttctgctttaagttctttgagaaattgccaagctgatttccacagtggctgaactaatttccattcccactagcagtgtgtaagcattcctttttcttcacagaggttagagtttgatagaataagatgcttaggatctattccatatttcataaacagaggtcacctggcagagtgtgtgtggtcatgagagaaagaaagaaagagaagagcttataagcatgaagactgtaggtttcttaactcatctatgaaatatttaatgattaattcacaattagcctaacagaagatattcaaaaatatgttaaggatccctttgtaaggaagtgaatgaccaccaataatttattattctatcaatattcttttaatttgagctgtcgagcagtattttgcttgagcaatccaattcacaaagaagcacaaaatactttgcattgaaacattgagcatcatttggccattggtacttctaaggtattttcttggtaaaattaagtctactcaatctagcttggtctgatgatttacctcctttaacaaagtctctaagttcttttcctctcttctttatgcctacatctaaaattacttgtgtacgtatttcttatttccttccttctcctactgttaggtaaattctaacaggtggggcctgcagattacttatctttacatctgtagtgcaaagtccattacctaggatttaataaatgctcaactaatgtccgttaaataggtaatccattaaattcattttgcttgatgtaataagccatttttcttcaaatactagatactttaaacattttagaagggaaaaaaaattaagaggaaggcctctgccccaggatcaataatgatgttgactttgttgcattttattttattttatactacttttgaaacagcaggaaaataaactaaaaagagtgtgactgtactgagataaacaagtcttattatagtaactccctttatcatagcctactggataccaggaaggtggatgaagtggtgttataccaggctccagtttaattagggaaaaggtaataaaaccttaagagctctgggcccctgcaagctctacaggtggttattctctactgatgaggcttgtgactttcatgaagtcagttaagtaaatctagcttcctcatctggcaaatggaaataacagttcttttttaaaaaccttacagaatcgaaccaatgagtaaaagaggttatttctgtgaaatcatgttagctcaaaaaactgtcattgagatacaagaactcatcttgatgcaccacgtagaagagtaatattgggaatctcatcacttattttagatgaaatatctggtatcttcaaagcgcggtgaactgccaattataatacaaaaataatggcggcatcccaatactgacagtaaaacttcagcttaatgtttacagaaacttttaatatccaaagaacatgtcttctctcctctgttattgccaatgtctaacaacatccagaatggtatcactcaatgagggcttgctcaagataataattagcttaaaaacttgataatggaaggcaacacattataatggctgaagtgtgggttctaaacttagattccctgtattcaaaatccagcccaaccacttatttaattaactaatctttgattaatttgcttaacctctataatcttaggtttcttcatcagtaaaatggaaatgataacaaagcctctggcccagggctgttgcctggatacaatttaggtaaagttctagcatagtgtctgacacatggtaagcactgaatagattctaatgtgttgattgatattcatctttttctaagatgctagaaattgcacacctttaccattgactattaaatgtgacatattcagtttaataggcaatgtgaaagaatgggttacatgtggtttaaccaaaaagtaacaacgtcatccctgatgttgtccatatgccatcacattcatctaataagtatcacaggttggtcattgcattgagaagcaggaacccccattttggcacagagtgaccatctccacagtcacggccgttcctcagcctggcagttaagcacacaatcacgtctttctgtttgctcctgtccttgttcatgctcaccaggtacaaagacaggagactggcccagcacaagtcggaaatagagtgtttcacccccaaagggagtatggggaatggtgggagagcaacaatgagcaggtaagcaaactatgagtggcctgaggtggtgtgaaataaatgtatgcaagctagaggaacatgtggctccctggtctgggtcctcactcaactgtgcaactcatacagtgtgtccaacccaggctactactggttttctatgtgtgtttgatttgcaaaacctatgacaccctcatgtgtagtaatgggagcctcctgtcccagatgctgctgtttcccagggttgtgcgctttgcatgtctgaagccttagctcacagtcagtcctcctctgggttttaacttattggtcaaacggttctggagtttgcaaagtggaagagattggaggaaactcatatttcagggctatccaatcacttaataaaacaaatacaaagcttagaactggttttaaggaaaggattactattgaaggaagactccagcccctgatcctggacaagcctggaaattaatataccttactttgaatgtaacatcatctcacagccaagggcaaatgccttgccaaactagtggactgtagagacaagtggcttttctcaaactgaaatcaggaaagctaatcctcctctagctaccatagctttgcatctcctttgcttccttgtgtttggtgatgaacattctctgtcgctgtgctgtgcatgttcttttatactaggcactcctgattgagttgtacctagtaaaccggagtatttggaagtataagcattaactaagctgtgttgcatgaaataaacgtgctttattgcatgggatttggttttaagaaaagggccctggggccgggcgcattggctcacgcctgtaatcccaacactttgggaggccaaggcgggtggatcagctgaggtcaggagttcaagaacagcctagccaatgtggtgaaaccccgtctctactaaaaacacaaaaattagccgggcatggtggcacacgcttgtaattccagctactcaggagactgaggccagaggactgcttgaacccaggaggcagaggttgcagtgagttgataacatgccattgcactccaacctgggcaacgagagtgaaaactgtctcaaaaaaaaaaaaaaaaaaaaagaaagaaagaaagaaagaaagaaaaagaaaaaagaaaagaaaagggccctggagacaaagtcaagattgacattaaacagttccagaatgttgaaggagccttgagttgaggagtcacttgccatgacttaactcttcacttctaatttgttgtgacatttctcaatccatctgtggtgtagaggtatggaaggaaaacttttgcaaatcatcctggattagagaaaaggaaaaattcaataagtagagtatgtgcatatgcatgtccatgtgctgagagcagagcttgagacctaattgcataacaagaagataatcctgttgaaatttcaccacaaacattttgtttgcttcctcagtggtgggctccttcctattttcaaaataataactacatttttccaaggcccaccatattgcacaactgctggtggactattcatattgcagtctatgaaaatggtgcccagaactgttcagcatacagtttgagcaatcattcacaacagtcctggccaagggcttggccaactttgtctatggttctcagagacaaggcaatgatagtgtgtgtacatgtgtaggcatatatgtgtgtactttggtgtatctgatggccttatgcctacaatccctttatacagctatctttggatctcagtgcatctgcaaaatgagtctcagaggatcattttgtggaagtgactcaacagaatgctattggggctcctattttccttccacttagatataacaaagtagcataattcatatccttgaaaattaggcaaacagcaccagagtaagctggacaaggttaaagtgacttcaccaaatgagtgctcaagggctcttcccagagtgacttctaatttgaggtctaaaactggagttcccaaacctggcaaacttagctgactatcaaacagactgaggcaaaatattgggcaatacaacttaggaatctgtcatgtaacaagtttcctaggtcatctcaaagaagccagtgcatgaactgatattttagagtaatccattcatgtaggagatgacatggagctgtttgtggcaagcatttggtctcaattatgcaattcgatgctcttagcagtgtttagtcaatacttagagctttagatctgatcatcacagaaattaaatttgctcaaggctgtcttaattgagaatgaggggaaagggacagagagggtagtacacagagagtaggagatcccagataaacataccaggcttccttgggtcaggtccagatctacaaaggtattcacttgatgtatctccagcaagaatggtctgagtttctctacaaccgcaagatatcatttaatttttgtttcctcacttgtttggatatagccaagataatagaaaggcttattacactgatatatcctggtggaggagaggggaataatgcatactactataaatacaattgtgttagatcatccacctcagccacacagataagcagagttaattgggaacaaatgatcttcccttcctagtatctcttccttctcatttctttagcactatataaaaactgacacacacacacacacacacacacacacacacacacacacagagagagagagagagcgagagagagagagagagaagagagacctgccatgcttaagctttcccttagggagtagaaaaggcctagagacatatgaaaagagaggtcaaaattcacaaggtcttggtatctttttttccaacttcacatttgttcacataaatacagacacacatgcctgcacacacatatttatccaggagaaataagtttaaaatgaacattaagagaaagctgtcagagaggagataactgtgatggaagccgtttctaagtaaggggttgaagtagttaatccaaatttgcttactcaggaatggaatagaagggctgaagaaaggttaactctatgtatgtgagacttttataggtacttttagcgtcaaccaataaggcctttctttgtaattcatccctactccaccccctattgcttccaggagtcaaagccaagcatcacatttactctgcaaacatctgggactcctctgtggccattattgaatagctagttccagggaggggttaaggggagctcaaacaaccacagaaaaccgagagtgtcactctgcatctcatttgcctgttttgtataatgaagctgtagaatggacagtactctatgaattcatgcctaggatgattatcccagagccaagttgcctggtggggaaagaaagcatttcacagtgtttacagttgaagcagagcagagcactattttctgatctgtaacattagcagggccttagacagatgctcctttacttctgccttcctccctcaaccctcatgctgggaaaggaatgagaatataacatgtccccatagcacactagcttcctgaaatatgttgctgttttccctttatgtgaagaggctttttttttaacctcatgtctgaatatagtataacttgtcatcttttcatattttcacagtggacagtctaagtgtgattcagagcagaatcctcctgattgcaggagaagtaaaagagagtcctaaacagggaggtggctctaagaactgaaattctctaaacactgttaccatgtgagttgctagcaagatggtccagcctcaggaatgactgaatgactgaaacctcaacactgaatgttattatcttctgtgtcagcaggggcatggcattggagtacttggaatctgcttgcttgcttttttctcagtcagagtctgcaatgtcacccaggctggagtgcaatggtgcgatcttggctcactgcaacttctgcctcccaggttcaagcgattctcctgcctcagactcctgagtagctgggattacagatgcccgccaccacgcccggctaattttttgtatttttagtagagacggggtttcactatgttggccaggctagtctcgaactcttgaccttgtgatccacccacctaggcctcccaaaaagctgggattacaggcgtgagccaccactcctggctggaatctgctttctgatgtgctcatgatgtaggccacgaaggagaaacaaagacattctgagcctcctagtctctctttgaggaagggctccgtcagtcaaatgaaatagacagctctctagtccccctccagtgccagaaggaaggagggtgggatggggttatttttgaacaaaaagagaattattattattactcttttgtgatataagctatgcaaactattaactttcaattagttgagtaactgattttctcctgtgatatgcagcatctaattttagtaggtacatatgtttaataaaggcttggagaatttggtaagagtcatgtcataatagtccttgttaaatgagtaggacctcagatagccccaaatacaatgtcttgtgttaggattgcctttcattcattcaattatttcttccttcaggtaaagctcatttattaagcacctattatgaaccaaggactcaaaagactctagagataaatggatgaccaagatatgactaatgcccttgaaaatctgcagtgtattgagaaacaggcagaaaaacagataactgcaatgcaatataaaactcctctaacacaggggagtttatgcctcagattaagtgcccatttcttaccacatgctatagtttgtaccagtacaaacagaattaaaagtaatagaataacacataataacagatgtaaactgagtattcagaaagtgtaaggcatgtagttatataatttaaactccatagataagagaaagattctgcctttccagtacagacaatagaagccagctggtttttgagaatagattagaatttctacaataaccttcactttatttatctccaaaatcaattccatattaatattctaacatattctaaaaaataagaagaagaagaattagtaacattgctatgattaccatgtatcccacactatactaagtcccttcatggaggttctgcattaagttctcccaagaacatataaagaaggtataattttttttcttcccatgctacacacaggaaaatgaggatcagggaaataaaataacatacacagtagagcaatctcatgaaaaatctaaaatcaaaggaacttcaatatctggttctggcactagccagtgtgtgaccacggagtgtcatttcaactctttaatatcaattttctataaacgtcagattatattatagcacttatcttactgtgatgctgtgaaaaataaatggaattatataagtacagcacttagcatattgcctgacacacaataggcattcaataaattttagcatgtgctcttactatccaaggccacccagtttagaaaggttgttttttacgtatttactgttttgtcttgtctttctctaccctgccaccatggttgtttgctcaaaaatcaattctggaaaagtaagtaaaacaaaatctaatgataacaaaagaataaattcaatgatataatttccctgttttaaaattcatgttctcccatgtttacctataaaagcagccaacatttattgagtacttagatacatgagacactgtgtcaaatgctttatctgcatgattgctcacttaatcttccttaaaaaattggtaaagcccatattagagcccaactcagtctgattctgcaattcacatactataatcactatgttatcagccacccaggaaaaaaatacaaactcatgcactcagaatacaaggttcttcataaactaaccctaacctaactatttgaccatcattccttctgcttctgtacatatgttctcctttccagacatcccagatatacaagtctccaaacatgctaactattttctacaacagcacatcttaagacttaagacatgctgtgtttctatctggattatccttcatttctctttctatccatcttcttccagggagaaggaactcccattgctgctccacctagcaaacctactcaggtttcaaaacccaactctaatgtccattcctccttgatgtgtctaaaagtcttagtctagctaaactctgcccaacttcataattctaatgtattttacctttacatccgatattgcatattatctagttgcctgtgtcttctcattaaacttgaggtttttaaggccacaaaacaaaaatgtatggttcacttttacgtcttcagtactcaacagtgtgagaagtctattgagtcaatcaaccactcaataaaagtgcctggataatttttgtgtatgtaggtagcattgttttagggaccatggggtgtttggggaagtataaaataatctccaccctaaaggaaattacaatcttaataaagaaataaaactcgctctgatggaacctgcaagagcaatagtctacattaaaattttaaatctgtgataccaataataaggccaagatttggatggtggtcaggattggagggaagcagggatgacagtatggctaacaataatggagccaacatatatgctcatatgcccttcttggaaattctcagtgaatagttacataaaaaattgataaattcatcagaaattagtttaatttgtttaacttatttgaccctgaaaccatttatttgaccctgaaaccatttattcatgaaccatctattgtcattcttactttctataccatttaccaattaattttataaaaaattaatcaaaaaacatagcatcaaaattatgtatgatgagtagcttatagtaatccttgaaatcttattataagcatttttccagataagtccttataagaccagcaaaaaccaaaaagattaactaatgtttggtgactggaattgaaatttactagctttattaaataccacaaatattaaccagatttctaattatcttttcttatttttctgaaagaattactaactactcagagtatattctatttttatattattaaattgaacatattctattttttatattattaaattgaacagtctcttttcttagcctgtaaaaaatgtaatacagaaatgtaacaggaatacttgaattctatgactctctcatctcagtttctgctcaattctcatcttatctaatactctttttactgaaaaaaaggaggagctggtcaaagccttgtgtgaggctgctgttcttgcctgtgaaaaacattttgtaaatagacatatatatgtacacacacatctatatgcacacatttatgtacaaatgtatagtttttgtagataattcagtagttatatacaatatatatgcatatattttatctgaaacaatagatttgctagcttgtaattttctgtaaaaaaggaaaaaggaaatcaaaatcatttctaatggaaaatgccaagccaaaatgggaaccgcctgacatgtagtcatcaagtccaaacttgtatgctcttgagagggaagtgaattttaaggaatactttctacttttagtctcacctaaagatatggataaaatttgggaattgtgtccaactaatcttattggcatattcccattatgtataatggtaatattgaaatgtagacgaaagttactcagcaaagctgagtgctctgaaaatttaaatcaatcattttatctaatcccatgtttaatgagttagtttgaactgattcttcaacacaaatgttatttattattaatcattttttaaaactttttttgccactgtgtctcacatgccttcaaagcacactaagcttttacacacactgtcttccattctccaagaatcagtagcttatcaaaaatcttggctttaccaagatgtttataccttaagtattttctacttttatgcacacaagttctttgaacctctctaatcctcagttttgtagtcaatttaatagcatgcatatgacaacacatatgcacagatatttttaaagattaaaagaatgtaaatgaggggatcagaaacgtgtgtgtgtgtgtgtgtgtgtgtgtgtgtgtgtacagaagccaatatattacaattgtaagaaaaaagtaaacattaatcaggaatagctgtatgtttgtgtaaccaattaattgggtacacaattaatctagaaatattaaggaaatatcttaatctggaaatattaacaaaatatcttaatctggaaatattaaggaaatatcttaattaacctacccaattaatttttaagggtccagagaaaggaaagatttctattgtctttgaggaagcaacaagattgacattaagcaaaataatggtgtccatggtagatttaaatttgttttaatagtacaaagatacagtgctcagcatcccaagaattccacaggaaatgggactagaactgacagatataaggcatatgcccattttatccaattaaaaaaaaaaaaccaggataatcaagaaacttccttcttaaaccaagagacttcactgacaataaacatattggtggtgaatctgcacccaggattcaagcctcataactaacatccccttcgtacatcagatttaagtcacaagcttcagctgaggtgctgtaagacagaaaggagtcttttgcctaaacaggaattattttcccagcaaccattctaaacatcctgggacaacttttatcttacagtccctcaggatttatctcagcaatgttgatgcagagctttagaatttatcaggttattttatgggcaaaacctggggcactgccatcttggatgctccacaggggtatgtcttgttagccccttggttcctgtgtgtatcttggcactcagtacacagacaatgggaatgactctggatttagcatcagatttggggcactgtcctgccatttactttgacttggtcgacttagttaagttccataagcctcatttctcatatctatagtgaaggttaataatacctgtcaatatcaaacattcaagatcatatagttcactttatttcactaacactcctctgcactactctgcaccagacaccatattaagcacaggagatacatgtagcatctgcccttgcaatgctctaggtttagtgcaggaacagacttgtaaataagtaattaaaaaactatctgataaatcctatcctagacagctgttatgaaggtaaaatatgatgccataggtgaaaacaccttgtgagctgaaaagttctattaaaatggaaactattaccattccaggattctcctcttctttgccaccaatcccaattccatgttttattcaaggtttaaatcaagctgaattcctccacaaagtcttcctgactgcagcagcttctagacacaaaacagctatgtctggctttgttctctatttactaaattataattgagctttatagtaattgctggtaaaaatcatttcctgttttgaaaaagaagtacaaaaatctaaaattcttgctaatcgctgttaaaacatctcagctaagacctagaacttaaatgtcaggatgaagagtagtttagtgagatttttttaaatttatttttagttgacacttaataattgtacacatttataggatacggaatgcttccttacatgtataccaagtgtaatgacaaaatcagggtaattagcatagcgatgaccacaaacatttatcatttctttgtgttgtgaacattcaaaatcctttattctagcttcttgaaactatacaacaaattatagttaactatattcaccctacaatgctgcagaacaccagagctcattccttgtacctagctgtaattttgtatcactttaccaactaataccagttagagtagtttagttttgaagctgagtccaggtaacagaattgtggatcaaaataaatagtttgatttgagaaggaaatatctgtgatgactcaacacaattccaatgcttggcatatgctcccgtgtcatattctcctttgttaaggtgcttgctccttatgaggactcaggggaagtagcgactgtactagtaccattaagcactttaataacccaccgtgaatgaacatgtagcttctgaaaaggcttcctgttgctgttaaaccaaagactagttaagagaggatcgagtgattctcctcccaccaggaatttattagggattaaatgcctggtaagaaagattctctgggggaattattgtggaaacatgtaaccactgctacttaagagagaggtgaaaatccacgtcacttagggctgttggaggagttgggattagacatgtagaattagtttcctttccatatatgcaatacatgtattaattgagatttgcttatccatgctattttaacatccccaagctttaaggcctcgttaatatccactttatttgcaaatccttccttgaaacttctttcctcagtgaacaactttttctctgaatttttctaatcctgataagaaaaacccaaagtctttttttttccacagtagttttcatgtcagtacattcctttccatcctcatttttgtcacacttgtgaataccttaacactgtattcctgtattgaattataaattccattgacttttttgatggtcaaacttttttttcctctattaatgtttgcttcctaatgatggtgtaccatggcagaatactctaatatctgcaggtttgagcagaggaatagagaaactgggtgaggtcattgacatgacattcagaccctgcttgaaaatgaataaatttgctaagtttctgatatggaagggaaaaacaggaaaaataaacctctgagaataaagatagaaagtgtcattttggcagacccaaaatgtaaacaaaaactaatgaaacaaataaacaaaaaacttaatcctcaaataacattattgatatgctgctttttgtttttcagaaataaagagcaaataattataacagagagaacattagatggcatcatattatattttgcaaaagggttaaatggtgcctggaagagagcaagacgttacttttggccccctcctcagatgtggcagatcatttcatcttgtccctttctccttcattcttctttccctctccttttctaatgtccaaaatattcagtgagggaaggtgacgtgccatagatgggtaaagaaaagttccctttcatttttcttacttcagcccccaaggacaaacatataacatggatgctgaaaaaaaatctcagcctaaataataaatacaacatcttagctcaactgaatagaaggtttaatgttaatgaataaccccttgcatttgcagaagggctatgctctataaagtaccctcatatgtattatccttttgttttttcccagacatcatgcaaggtgggcaagggaggtttatttcttttcttttcttttctttttttccaataaagaaagaagctcaaaggtggcaagtgatttgctcaacatcattctgagtcagatcctggactgagaatctgggtcctttctttccactatcactactgcctcgatgagatttcaccactgagcaattttactaagacagatatgagttataaagaaggaattattttgtgattttcatggcagatatcaagctttgtattttcatatttaatgaaattttttaaatatgtagacattgagtactattgattaaagggaggtatataagaagtaaaagtagatccataaggcaaaatagagtttcattaacactgaattattttaaaaacttaattctaacaggaaaacaattcagtataaattttaaaaataaactgcattttatctactcaatcattggcccaaaaatattactgagcactaccatgttctaaacaatgcatgggtactactgggcatataggaaagagcaaaccctccatctgtgccttcataatgtcccatcaagcaggtgagatagacatatagcaaagagttatgatatgcctgaatgcaggtgccataggaatctagcctagcagggtcaggaaagctttctttaagacaagacaattaaggtaaaataaaataagaaaaaaagaggatacagttaagcaaaaaggaagagaggatgtagcacaatgagaaagcatttgaggaaaaaggttaatttggaatttaatggggtagaggtgatcacccaaggagatagtttagggtgtgaagaggccacggatcatggaactccaggtcaggtaaaagagaaagaacctgaaaggttttatggcttaccaaatattttactttgcactgaattctctgttccttaaaccagggttcaaaatggcattgagtatactttttattttctgaaatgctgtattcacataaaatataaaaactgaacatccttagacaccttctctttaccagctcttttcacctacattgtctcatgtaatctcaaaacaaccttaaccaaatgagacactgtctgcttcttaccgaggcttaaaaagattattcttttccaagtatctgggatggcagatccagaataagaaccggattttaggatctctattctattgcaccttccatgacaccccacagtggccctgttaacttaaaaatcctattcatccatcaaatgcttattaagatcatgctgagtgtcactgaaaaagatagataagatctgtgtcttcatagaatgtactttctactaataaacagaataatgtcgtgagtagggagtttcttttgttttttttcttaagagttctcatttacttcagggaaaaaaaagctttcatgttcaaaagaatgaaatgaagtactcacatttggactccatttctctgggtgtctggtgtttcctgtgtccactttcacgttattcagatggtctggtgctctttctcccttatggccatgggcactgtaaccaaaggcacagccaggaaaaagatgtcaatactttgtacagaattggttgattaggatggtttcctcatcacacactcacctagaggttttgcaacatgctatcatgttttggggcatggctacaggtgattccaaagactgttactgctaacatccaaagttatgttccatcatgttcaactaaaggcattcgagagagagagagagaaactttttaaaagctagtgtttgcaaaacctctctgtactaggagcaagagtgtccctaaggtaaaagttggtggaataaatccaattagtctcctgatttcaagtccatgctttgtattaaaaggggacttagtgacctgaaataatacttgtacctttcgaaacacctgtttcttatccttctgataggagaaagggtgtagttggcaaccatcctcccaatcaaatctcgtaaataaactggcccatttcttctctgccatgttccagaagctagtggacacctgggaaaaagaattgtaatacacgtaagtcaggctaatgcaaaattgaaaaataaatcctgaaactactagaaaggaacaccaactgtttggcagtgccccctctgctactatggatgcacagcaacctccaaacctgaaaatggttcattcatcctttccaggaagggcagagtggggtggaagaagctcatattccaggattctgaaggacatgagactacaatatattgggtagattacatggaaagaaatttcacaggaaagagcggagaaagaaagaccatgaagtagaaaggaacagataaagaaatgggaagcagtgtggaaagaggcaaaaagcatgtcattaaaggggatgcagaaatggcagtctgttaccaagggagtgggtttctcagacagagtggatcctgcagggccagtcaggcagcctcaaggctggtggattccaaatgaggtacacgccccagcccctcaaaggcaagccagccctccagcaagggggcccaaggggagtgatggggatttagaagaaaaggatggctttctgccagagtttctcagattgtgaaagaatctgagaaacaaagtgcttcagatttactttgggagcagaagaacagaatgcttgtcaaaagcatagatccttggaagccaatccagacaatcagactctcctggggtcacatcttatatctttgacaaatgccctagatgagtcttacacagaatttagtttaataaccataggctgtgatgataaaactgtagtcttcaacttcttttgtagtcaggctgctcaaggctatctgttggtcacagcccctagaacagagctgtcttgactgaaaataacagaccccctagtaacagagatcttggattactttgtgatgggaaactacaccagaatctcttcatataacattcctggccagacgcagtggctcacgcctgtaatcccaacactttaggaggctgaggcaggttgatcacttgaggtcaggagttctagaacagtcttaccaacatggtgaaaccccgtatctactaaaaatacaaaattagctgggcgtggtggcgcatgcctacaatcccagctactcaggaagctgaggcaggagattcgcttgaatcccagaggccgagggtgcagtgagctgagatggcgccactgcacttcagcctgggcaacaagagcaaaactccgtctaaaaaacaaaaaataaaaaaaaatcttgagtgtcaggccacattctctgacctttgtaaagtttctgaaagaacgtctgcagcttcagaagctattgtgtcagcttttagtggtaaggagaggtactagggcgctgaggctgaggcaccaatcacatcttgagagtggctttcagaccccatggtggaagtgcaaaggagaaagagagagaaaggccttcaaaaaacttgtcagtccctcaatattcaccaggatcctaatttgagatcactctgctaagtgccgaaggcattatacagcactctcactcattgaactgttattcaagtacagaactcaaaatacatttgtgaggtgaatttctgtgaagtaaagaagctctcattagaaatgtgtgttcattaaatttttattttccagcaggtaaggcagcctaagtaacactatgttcaaaatcaggggttcagacagaaaaccctagttatatatataccaacttccagaataaaggcggaactggaaccactgactacctcctggtaatccctgactctcttaccccttccctcctctctgatgattgttggtgagtttgggtcctagtggtaatgttttccttcagaggccactaactctaggaagcccctgtcctgtaccaggcacttgtgcacacagccgggacactgcaagcccttgcatctgtgtgctgctgcactcacaggtgggctcagaactcccgcagaatcctaataaacactccttcatcctgacaagcatcccctttgacacattttcacgattatgataaactgaagccctgatatagaaagcagtctttaactcaaaacaagcaaaggaaagccacttccaaggtctctttccatgatgtccttttgatgctgtgtttcctgaaagaatgagaaaagtcctccccagtccggggcccatgagcaaccaccattggggaagcggcatccaagccccctgggcacctcgctgagtcacctttcctctcccttctctcctcagttccaatggaaaatccgtcacgtgggcccagaatgagaagagcagccgggggcagcacctgtggcagcgcctgtccatccacatcaacaagaaagaaaaccccaaccaaacggccgtcatcaagcccttccccaagagcacggagagccgtggcctgggcgctggcgctggcgcaggcgggagcgctgggggcgtgggggccacgggcggtgcgggctgcgcaggcgccggcccaggcgggcccgagtccccagacgccggccccaaggcgctgtatgatgtggccgaggctgaggagcacttcccggcgcccgcgcggccgcgctcaccgtcgcccatcagcacgctgagccaccgcgcgggctcggccagccgcacggacgacgatgtgccgtcgctgcactcggagcctgtggcgcgcagcagctcctcgcagggctccctcatggagcagatcagcagtgtggtcacccgcttcacggccaacatcagcgagctcaactccatgatgctgtccaccgcggcccccagccccggcgtcggcgccccgctctgctcgtcctacctgatccccaaagagatccagttgcccacgaccatgacgacctttgccgaaatccagcctctgccggccatcgaagtcacgggaggcgcgcagcccgcggcaggggcgcaggcggctggggacgcggcccgggagagccccgcggccggtcccgaggctgcggccgccaagccagacctggaggagctggtggctctcaccccgccgtcccccttcagagactcggtggactcggggagcacaacccccaactcgccagtgtccgagtcggccctctgtatcccgtcgtctcccaaatatgacactcttatcataagagattacactcagagctcctcgtcgttgtgaatgtccctggaaagcacgccggcctgcgcgtgcggagcggagccccccgtgttcacacacacacaatggcaagcatagtcgcctggttacggcccagggggaagatgccaagggcaccccttaatggaaacacgagatcagtagtgctatctcatgacaaccgacgaagaaaccgacgacaaatcttttggcagattttcttctagtggccttagaaaacatgggcttttaagaaacacggctgatatctttgagggctgacaaggcgtctcttcaaacagttccataccaagtgctttgctctagggaagcagtgcgtgtgaaacagcgtaacggagggtgaagagcatagttaataagcaactgtaaaaagttttatttgtttactttaattcttttcccagaagagtctttgattcaccaaacatgaatgtacattttctaacaaactcaaaatctgggaccaaaacatcaacttttttctttcttttttctttctttttgttttttctttcctgtaaagaccttgaaaagcagtaacttgggtccagtatttacggaggcgttgtgaatgtgtcccatgcataacacactactggatagtgagtgctgcgctaatgtactacgtagggcttctaccagagattttcctctccaattgggttgtgaaatactcttccaaaagcctgcatcggggattccacctacttatttcagattcacctccattaaccaagaaaaccagtggaagatttcttgactatttcaccatgttgccaatcaatactggagtagcaaaaaaaatattttctggaatactgttttgtaattccctcactggggtgcattgtagctggaaattctctttataaaaatcattcttgagctccagcctggctatctctttcaagaaacatggccactctttaggaatgctgttgcgtttgcattgccaactaaaatattaaaatatgcattggggcttcttcattcctttattttgagaacctgatgcacaaagagctcctttgttcttttcgagtcccaccactggaagagtggtccatagaccccatgaagacattgtcatgatttgagagactgttgttgaaaggattaacacaatcttaatacactgaaaattttaactgtgtcaagtcagcttagtggagatttagctatgccagtgagcagtgattttaactattcttggctgcttaaacagggcagctatgaactatgacaaatgtagatttttcaaagcaatacaaaatactaaaaaagaggaaccttaatgaatattaaccacacagtctttcttagccattccaaaaagaggcaaagcaattcttattttcttttttaaaataatgattaatatgattttgtgcacttcatactgtcactttttaaaactacagaaaagagatttagagtataacagaaacaagtgtgctttgatagtctcaaataggtagaattcatagttcaagacctgaatccactgtcatctctttcttcctcccattgcagctatcctcaggtaccaaatgttttgatttttaaataaggatagtaataaatggaggaggtgtcctataaatttaaagttcagttgacccagccttatacttaagatagccttatgaaaaatatgtgctgtgaggcagaagtatattttggcagagagaataataaataaaactttttcttttagctcaatatccttactttggtaagtatttttttttatttcacatctacttaacagaaaataaactgagaaatagaagtcagtccattggcataatttatcattcttcactttaaaaaattctaataaatattctgcttgagttttcttttctgctatttgttcttacttgcaactttaagtcaaacctcccaatacaaaacattaaaagctaacattaatgtactaaagtattaatttaaaagaaatcgaacctcccatgctagatttgaaaataacatcatcacagcaccctgatcccaaatattacaccgaggcttttaaaatgtaagtgaaatctagctaagtttcatggtttcattaaaagcaaatgtctgcctctatctgaaaaacaaatggaaatcttttgaggtgttaataccctttggatcctcatcaaaaggatggcattcacctgaggattcctatcttgacttcttaggtattaaaaacctttcttgatatgctctacattttaaaatttgttttataaaatccttatgttgattttcattttattctcaagtacaatacgtttcactctagaccagttgaagaacatgtttaaactttgttcatggtcaaattcattttctatttttttagtaacatatctcttaaaaagcacactaccttataaaaaacttcatcagaaattaaatttaatgcaagtaaattgccatctgatacttccacatgctatcataatcaactgtaataataaaaatgatttatccaattagaaaaggacaagatatatttttctctgtatttctataacttttgccactccattgaatacattgtatgttggacataagattattagtaatgcattcttgagatcttttattttggaatgatgctaactctgtctctttgccaattctaataccaggttccaagtaataactctacagtacaaagagaactgaatattcattctagggctataggatatgaacttcacaattcatttgggtacattctcattgaatttccttcaaaacaatctgttcctggtgcccagtgataattcagtcgggaccagcatgactaaaaggaaggggatatgctaaggctcagcaaagtgaccctaaatgagagatatgtcccaggatggaaagaagaagacgtggtttaaccaagttatactgactaatctaagcagtccactcatccttccattttgggaaaggagtgggggcagcctaagaagaacatatctggattgggaagaaccgtctttctgggctagggatggggaacagaaagggagtatggaaagaaaaattataagagatttgactgaagcaaggaaaaaaagcaaatccccaaacgtgctaatccttgaaagtaactatctttcccaaactactgctgttaccagcaagtgatcaggaagactaggagctatttctgactgtaaatgaattgtataatagctctgctgcagttctgtgacttccaagccaggaattaaatgctctttttaagaataacaaaaaacaaaagcatttcctatgctagtctcccagtaaaatgtacatgttttggagacttcaaaggtattatgtgagttcacatttagcaacagcttattaataaccctcaagctgtcagaatctctatagttaccatttacaattttatactgtgaaaaaatacagatcagtgaaagcataaagacaagtcagaattcactttgaagagggtctgaggcctgggagagtctctactgtctattgaagaatgaggcatgtataaaatagttggttgaatttcactgatcttcccaatgtgaacaaatatactatgtatattgtgtgtatttctagaaatcaatggcagctgctgatggtgttgtaattagaaatctatatagattatagatgttttagaaagatggtgccaatcctaaaagatttgtgtgggctaaaagtgcttgtacttacttttttctgcacttataactgatttggttttaaaattgtgtgcgtgtatctgttctttctctgttgtggcagcttgtactattaaaataatagagaatgttaaattattttgatgtgaactgcaaatgattttttttcataaagtttaacatttttatcagcattgttttgctttgtacttgtataaatatgttttattttagcacttcaaaatatacttgcctgtttctcagttgtctaaatcatgttgtacttggtgtttgtgaagccagttacttttcaaaaaaattaaaaaacctataatatgattttaagattattcccctcaaatgtttagaatgttgtcttaatagtgttttctgagatgaaaagagccatgatactaattaatcttgaatactggatgatctatacatttgaattatggggtttacaaagtaagcagtggactgtatagatttaaatgaaaatataaaccaaccacaaaccaaccagagatgttgtccccaaacacatctacaaacaactgttacataaagaagtacttaaaaaaatatataggaaatatgcattgtttatgcatctagacatacaaattatagaaatagtttcataattatatgtgttgatagaggtaacatcacacagataaaatagattatttgtgtgtgtatagatgtgtgtttacaaacatacatatttatatagacatttgacttttgagtccatctgcatgtgtctctgtgtatatgtgtgtttgtgtgtagatgtatgtgcatattacataatttttccagaaaaaaaaaaagttttactttgactgattcttgagcaaatatacattccctggacacaaattagtgaaaaactaacagcagaatataaggtagatgcttgatgtatggaagagaaaaacaaggtatatttaaaaatatatttgatttatgcttctgacattgtattaaatgcataatgatatatatacatatgtagatacatatattatacagaatgtgtttgatcttaacaaagaaagccattttatctgttttgtcagactcttcccttcagtatcttttattctaacgtgatatgaatggtaatatgttcacataaaattgaggatgaagtgacatatacaaaccaggtacaggaaattaccttctaaaaatccaaagagccttatcagactccatcaaattatggaaggccatttaaaaccagcggatgcaatagaaatagcattgaattaaaagccaggatctcttacctgtcaccaactgactttggataaatcactctgatttctctacaacttgttcctcttgctttaaatgcagaagtgagttacaataatctgtgaagtttctatcatttcaacattcctgataaatgctcaatagtagctattattagtgtcaatgtagtatttagtatacagttaatattcagcaggaagcttaaatttgttatatcaatgttatttgtggagcttaacaagttcctgtccaacttaaagcatatatcctggaggaaacctattgaggtttgaactcatatgcaaccttggaactgtctatcaaggacaacttagtaaattgatattgaacaccacagagagaatgcttttcctctgttataattgctgctgaatgctggccaagtttttggttatgctgtacatgaatgatcagttttagaacataaacaatttgcaaatatttactttgtatgatagctaggcagaaaggtaggtaagcacatagataggcagaattatattaatgaagttatctccttaagcaaaagcttggtatttacattttctctcacagtattttaaaactcagaatcagttattacatctcactctgtttattacttttaggttattatgttagtaaataagttctatgaagagaatgtttaaactcatcttctccagccactcttagaatcctgaaccaaaagtttccaggaacacttaacctccactagaataaatgttttaaattactgttacaccaggacaaagacatttatttttgccaggacataagtctctttgaggtatgatctatatacaggatacctatgtgatatacatatcagacactttggcttatttatgtatagcttgtatttttattcattgacattaaaaataaaaattttcatactatcagatttctatgatgagatagatgttatattttaaattatacaaattctatgtccgtgaaaaccacataataaattgtggcttttctgaactgctgaatagtaataggtgattcataaaagttcttagagtcttaaaagtttgaaaaatgtagtaattccaaattaaatggctatcttcacttcggaagttaccaatttatagtattcctttttttttttttttttttttttgagacggagtctcgctttgtagcccaggctggagtgcagtggcgtgcagtggcgcgatctcggctcactgcaagctccgcctcccgggttcacaccattctccctcctcagcctcccaagaagctgggactataggcgcccaccacatcgccggctaattttttgtatttttagtagagacggggtttcaccattcgcaggatggtctcgatctactgaccttgtgatccgcccgcctcggcctcccaaagtgctgggattacaggcgtgagccaccgtgcccggcccaatttatagtattctaatatccattaactttgctaatgaagctgtctcctcagagtagagtttcatgaaaagaattttggaaatgctatgatataaaagttataatttatacacactttttcttttagttttcaaaattcattgccatttccatgatgatctccttaggcctttagagaagtaaacacagattgatagagttataacattgtcttcaggagccattttactgaaccattggaagtcttgctcaattttattatttgttctcttcccattttttgatttcttagacctctgtcagcacatttactttactttcacgggtcaagctgagggatttcttttacaatttatgttctttcatttttgttcaaaacgttttgaaccaaatgaaattaagtttccttaacttcaacagcctcagatgaagcaatatgtgagatacagcattaatagatgttgcctaaccagtgaaatgtatttcaaaagcagtagaagtctatcagcttattatccagaagctatttttagaaactctttctaacttaaaaacataagagcaaaactacatgaacacatctataacacataccacataaatgcatttctactcttgcatatttaagataatgactttagccctttacttccctatatgtgtggtactctctatcatattttctgaagagcttaaatcccatcattagccctaataattcatcttactcttcaaagaggaatgaaacaatctaaatgtatacagagaaaaaaagatcttgttttgggaagacaagtacccactctaataacccgagacaacttagcaacaaaattaggagaacatcctagctagttctatccagtcagtatgaaagaagccagtggaaatgctttcttattctttgtatggctataacaaaaaaggaccaaagttggtcgggtgacccatcccagcactttgggaggccaaagcaggcggattacttgagcccagaaattcaagttcagccttggccacatggtgaaaccctgcctctacaaaaaatacaaaacttagctgagccgagatcatgaaactctgtctcaaacaacaacaacaacagcaacaaatagaatgaaagaaaaagaaagacaagcacaaaagtcagattctaaagaataagacgaagatacaaccatttctgattgacaaagcacaggtcaggagcgcaagaaaaatgtgagtgatgaccacagggccaacaaacagacttaaatgcccaaataaattaaagaaagttaagaagcactcagaaaaagaataatgcaaccatgtccttaagtgatggtatttgctgaaccagcaccatcagttaaccagttccgatatatacaaagcatttaaaggagcaaatgataaacaaaggcaggtgtaagaatattaatgtccaataagaaataattaaaaataaaagccattaaaaggattaaaagaaatatttaaaattgataaaaaatctacacagaaggtagaacagtgatgaacctatatgtgcttaaaaatagggcttcaaagcctaataaacaaagattattggaaacacacgaggaaaaaaaatccacaatcacaatgacttgctttaatatatttaactggcaaatacatcaagaaggcaaaagaaaaaaaaaaatctatgtaattaagtaacacaaatagcaagaataatcaaacacatctacttagaggtttgttcctattaacagaggacagacattctctttctcatcattaaaacattcataaatattaaccttggattaaaccaggaagaaaattttaacaaattccaggaaacgaaaattaaacaggctacattcactgactaaaagaaatcttaaatttaaaacaaaagttatccaaaagaaatacgttcacttacaatctctcttttaagatagctttctggaatgaagagaaaaacttaactaaaatcacatcctgtttataaatgaacattggtgacagttctgtatattaaaatctatagaacagccagagtactcaaaaaatgttttatcataaatgtatatgtttttaagaagactgaaaataaacattcaactgaagatgttgtaaaataaataaaaatcaaatacaatacaaataactaatattgaacaaatgaaagtaatacaagcaaacattttaaaaaattaaaagtaaccattaaaaccaaagtcatcgactggataaagaaaatgtggcaatgtacaacatggaatacaatgcagccataaaaaaggatgagttcatgtcctttgcagggacatggatgacagtggaaaccatcatctcagcaaactatcacaagaacagaaaactaaacaccacatgttctcactcataattggaagttgaataatgagatcacattgacagagggagggaaacatcacacaccagggcctgtcaggaggtgggggactaggagagggatagcattaggagaaatacctaatgtagatgacaggttgatggatacagcaaaccaccatgacccatgtatacctacgtaacaaacctgcacgttctgcacatgtaccccagaacttaaagtataataaaaaagaaaaaaaaaaagattagacccaagtaaccatgatggctctccttcccttttgatggaaataaaaattagggcaaacaatttcggtcttctgaaataaacgttataaaaactaaaacaaaatgaaataatgtccaaacacaattaaggctcagtaataataattcagtgtgagaaaaattattgatgtatttatcacatgaaaatacacaagcacctcaatagatttggaagggaaaaaataaatttgatgcaatttaaaaaaaaaagtcatctgtttgaaaagacccacatgttaacattcatcaaatctaattgagtaaaagaaaacacaaattataaacataaacaaaattagtaataaaaaatatatacatagaaatatagacatatcaaatttctaagtagaagtttatgctaatacatttgaaaatataggtaaaatgaatattattctaaaaaaaataattaccaaactgaaataaaagtaaaaaaaaccctagaccataatgatagaatattgtaaaagagaattttaaaatatcttactctaaaaagtacaagcctaaatgttttacaggtaaattacaccataacatataaatatagaagatgaaaaaatatggaaatatttatagcttattcatgaggctttcataactttggcacacaaatcagacaaatatggaaataaaaggaaattatagtcaaatctcatttaatcaaatttcatttgatcaaatatcaaatatatatcattattttgtaaaatactaaagtatttatatataacactataaaacctaataaactattaaatactttatgaaggagtatattttgcccttagattgtaagttttattcaaaactagaaaaatctatgaatatggtttactccattaacatattaaacagaaaatgtaatatataatataaaaacatttgataaaatccaacactaatttctgactaaaacaaaataaattagcaactaaaactaaaagaaaactttctgaaggtaggaaaaaaaatcagacacctatagcaaatataatactaataacaaaatattagaagaattcccattaaatcaggtgtaaaagaagtatgtcatatatgtacaatttctaaagtgaatatgtaagctttgtccaaaacaggtcatttctgagagttaaataaagtgttagtggtatttggagaatggctttacctgggaaaactgcttatatctggactcttttgaacaaactaggacataagcccactttattactattcaataaatatttaaccttttagataaaactctgtgaagtgcctagcatagcatggaacatacagtatgttttttcaatgctagctgctttagtagtaatactactagtggtagtagtagtagtagtggtaatagtagcagtgttagaagtttagatctaactaataaaatatttaaaatgtaaaacataaaacacgagtggcaatattcccatgcaaaattagttattgctgcttatattcttgtgtatatatgtatctttccctaacaattgaaacacacaaaaaaatactaatcactcatattgttgcaacaaatatcagaagtaaatataagaaatgagttgatatagccatttacaaccagattagattaaataaaaaagtgaatgaaattgtttctgcttagtaagtaatgaaaatacataaagaatacttaattacaaaaaaaaatgggaaatgtggcaaagacctggtgttcgaatcaaaatacttaaaactggagagagagaaagaaagaaactttagaagaatataacctgcattatatatgactttagtgaagagacttcttcagttctggagccgccttcattcaggtaagcccccttctgtccatctttttcttttataagttaaaacaactgtcatacttagatcagtgttaccaaaaatttcagttattctaaaactttaacaccattaaggcagtataaacatacattttaacttctttttttttttattgtggtaagaacatttaatatgagatctacccttgtgaacatttttaactacacaatacattattgttaactacagacacaatgttttacagcagatctctacaatttactcaactgcataactgaaactttgtaccctttgattagcagctcctcctttccccctaacccttgctcctggcaaccaccattctactcttttagcctgtgaatttgactgtcttagatacctcatataagcagaatcatgcagcattcatccttccatgactggcttatttcactcaacataatttcttccaggttcatccatgttgtcacatatgaaagatttcttttttttcaatagtattattgctgtatattacaataataatccattgtatgtatatactttattcatacactgatgggcatttaggttgtttccacatcctagctattgtgaatatatatatatatttagataactatatttatataaccaaaccagtggtttggttattttatatatactccttaatttatataattaaatataatatacttctgatttggttgtataaccaaaccagcggtctggtggaactgaagtacagagatcttataagatctatatatccacatgtagatatatatatatctatataatatatatagatatatattatttatatagatatatatatctatatttatataaatatataatatatacacacatgcacatatccacatatatcaatgaataaagataatataggagcaaatgttatgtaatatgtaattgttatatatatagatcaaaaataaatttttaagcttaaagttacttcttaatcattactacctaaaaattatgacctttttaatcctaagggatgttgtgagattacatatctctatgaaagaggttcactaatcaaagactgaataatacttttttatattatccttatagttaattttagcttaaaaatcactgaactttataatagaaatggaagctttaaattatatctacctgagcaataatttttcacaagtgaaaaacagacattccatgttgtagttgagataagcttgatcaatgaatacctcaatcctagctctggctggctcaaaggcaaagtacagagccagtttcactaatactcttaccgcaaactaccccattaaacttggggactcaacatcactcttaagcaagctatttgttggtataacactctccaaacttttccttcttgaaaagtatgcagctggtcagcagaagacctgggattcaaaactatctcagactccaagatccatcaatcattctagcacatcttacatcatgagacataaataagatgcttccctccaaaacagcccacatctgaatcctgcgcctcattctatagccaggaaagagataggaccttaaggagaagagcaggcataagtgttctggtgttcacggggcatagagaaggacaaagtggtggtatttcatccagcagaacacagagcactttgccctggggcatgccatcacctgaagataaggagccattgcaacaactaagaggcacccagactagttgttgagggttatctagggaagttttctagagaaggtgatgctagaggtaggattgagggactactacccacaggatattctggacagtggaaacagcatgtacaaagacatgagtctgaaatgcaactatctgtaataaacaaccagtggtttggtggaattgaagtacagagttcttataaatattaggaaaacagcaaaaacaggttaaaaaaatttaagggcttatatgcttcaccaagaaagttagactttatctttaaagtgataaggagacttcaaagggttttaagagtacatttgcatgtgtaaatttttttttctaaaatatgattttgatagtcatgaaaacaaagaaatagtggatgagaagtcaggccaatgtagatgataatctactggacttgggaactaatcagagcaagaattgtgcagatggtgaagaagcagtgaatttagaaaattttctgaatgaggattaatataaattgatataaaaagagtgagatggagtggtccaagatgccaccagctgtcttttgactagcagagaatagcatcaattgctgagctgaggagcaggtttgtgatgagttctatattggattacagagttgagatgactgtaaaactacagtcaatatgcccagtaaacagtggataaagggagtagatctcaggaaagagaaagcgaatgagcaggaaacagcacacccaaaatgatcattgaaaatgtgttaatggatacactaaaattacaaagacaggagcagggttaggaaattaactagggattagcagaactagtaacaatgtgaagttaccatgatccccagccctgaatgggtaagggaagaatttacttaatggataagagctgcagctataggagagggccacctaaaggcgctgtggtcttggaactgggaaatgtcatattccctgtcttcaaagttgccctcacatctcagatgggctgcctagaagtatggcagttgagtgcatgagatatgcttacccaggagagggtagtcattaaactctcatagcttgttccttgtatcagcctaggagactgcccattaccaatactttaatcagtcactcttggatcgatgcagtattatatgttttaagtaacactgacaactgtatgtctatgtaatcctaatttcctgataaccaggaaaatcagtgttttagtccattcttacactgttataaataaatacctaagactgggtaatttataaagaaaaagggttgaattggctgatggttctgcaggctgtacaggaagcatagttggggaggcctcaggaaacttacaaccatggcggaaggcaagggggaagcaggctcattttacatggccggaacaggagaaagagagagaagggggaggtgctacacacttttaagtgaccagatctcacagtaacttactcactatcacaagaacagcaccaaaggggaaatccacacccatgatccaatcacttcccaccaggccccacctccaacactggggattacaatttggcctgagatttgtgcgggacacagacccaaaccgtatctgtaaaacctacaaatcatgaaaattaggaaagaccatggagaccacctaccacagcttatcatttccatatctctgaatattcgtgtaactaggaactaacactgtgatggggacacatgaaaccagagaataaacacaatcataaattaaggcattcattgtatattaaacttacaaatttaaaaaaaccctatcattgtgcttagcaatattgtgtctgaatatgtatttgtttaattttcatgtcttttttagttagagatgagtttgcagagagtactaatttgcccaatgccaccattaattcataaaagagtgacgaccaggaagaaggattgagcacctgctatgagcctgtaactcgaaatggaagacataaaatgtcatttttctcatgcaaaagccattgtggattagactggtgcccatttcctagctctcattctaaaggctttctgctccagcatgctgtttctctttggtttggcaccctgcttgttcaatgtataatttcattagcaggaaagcccacagagatatttacatctaatttgccctcttgctgtagcctttctcctgcttgccatgctgacaggtggcttgaaaaccgtaaatggataggattctagagaggcagaacagagcagctggcaagccaaggtcaggatgacatccaggttcaaatgattctacaaaattggaatcagaattggaactctttcttccttccaaattctttcctggagagagtaattcaggatggtcccaaataagttctcacttttttaaaataaagaatatcatgcgctcatgcaattgccagtttgcaaacatttgcagcaaaggagtgagacagggtatagagcagcttttctctcagcattctgcagagatgagtctgatacacttctggctcagaagccctggccaagagattgtagccactgctaacatcatctatctgtgtggacaatatgctaaaaatccattcttccaacagataggcaatgttgcatgggataatgtctaagtgaaaatggttgcttttcaagattatacctttctttccctactcagtccactttgattaatttattttaactcaatctcaccatcacatgcccctctgctgctcaggaaggacatgcatagcatcagaggcattcagagtgctaagagacatgccgttatctgaaccaggcaaataactcaatataaattctccttgccatgcatctagccttgactgaagtgacaaactgtatctggacagagaatgcacagagaggtagaagagggaaaggaggggctcagcaagcttttagatagcatttttattttattattattttattattattattattattttttttttttttttgagacagagtcttgccctgttgcccaggctggagtgcagtggcgcgatcttggctcactgcaacctccgcctcccaggttcaaatgattctcctgcctcagcctcccgaatagctgggattacatgtgcccgccaacacgcccagctaatttttgtatttttagtagagacgaggtttcactatgttggcctggctgatctcaaactcctgacctcatgatctgccctcctcagcctcccaaagtgctgggattacaggcgtgagccaccgtgcccagctgatagcatttttattttaaagttttaaataggtttgtgaattctagtcaaaattattggtaaatgaaataaagagaaggttgacctaggttttccagaggactaagaatgggaaggttcatacaaaaagcaatggatttgtaatctccccaggtctgcttcttactaacattctcagaatccttaccttaccaaaggtaatccttaccaaatccttacaaaatccttaccaaagaaggaaggccttctttgcaagataaatggtgtctgaagcaaaataatgcttatgatcaatgtcatatgttagttgttaattattattaatctccattataatgagctccattctaactaagatttgcattagctttttgttaggaatgtgatcatatatccagtatgttcgaatgctaaaacttgaactagatcttctaacttctgtcctgatgtaaggactacctgcacaataccacattttctcctcctttttattaaactctgctataacacagcatttgtaaaggaagttgccactttcgggtcacaaaggaacatggctaagtgtgtttgtttcttagagaagcacagtcatgcagtttaacattcctctttcccttcaccttgtgtctgcatctctacagaatggtattagatgacagctgctttggttacataggttggaatataagaaaatagtgtgaaagtagaaatacttttagtttgaataaatattggagcaatagcaaattaagaggcaaacagacagacagtgacctagatttggtttcaacagacctgggttaaaattggagtccattactaaccagctgtgggatcttagcccacataattgaatttccctgaatcataattctattttctgtaaaatgaagaagataattgtgtccagcctatttcagtgttgctttgaagttaaaataattttataatgtgtacaaatgcctttgtaattataaaggactatgaaaaatactagctgttagctgttatactaagcactaaaatattgaaatgtttctgttcaatctcctatcaactcgattctagttgcgtagtcaaaatctaaccttgacttcatttttcctttcttcctttttcatgtcttcatagctctcattcaacatcaaaatatgtacagaatcacgcgaatttactgaatttatttattagttctgagagtttttcagtggagtcttgagggttttctgcatataagatcaggtcatctgtaaacagggacaatttcacttgctccttttcagtttggatgccctttatttctttctcttgcctaattgttatggctaggacttctagtactatattgaatagaagtggtaaaagtgggcatctttgtcttgtttctgaccttagaatagaagcttttatcttttgcttgttcagtgtgatgttaactatgggtttatcatacatgccccttattatgttgaggtgcataccttctatgccaaatttgttcagaatttttatcatgaaaggatggtggattttgtcaaatgctttttgtctgttgaaatgctcgtattgtttttgtctttcttactgttaatgtggcatatcgcatttattgatttgcatatgtggaattacccttgcatccctgggatgaatcccacttgatcatagtaaatgatcttttcaatgtgctgttggatttggtttgatagtatcttgttgagaattttgcatctaagtttcatcagagatattggtctatacttttcttcctttgttgtgtctttgtctggttctggaatcagggtaatcctggccttgtaaaatgagcttggaaatattccctcctcttcagttttatggaatagtttgaggaaaattggtattagtccttctttaaatgtttggtagaattttgcggtaaagccatcaggtcctggacttttctttgatggaagactttcaattactgattcaattttctcactcatcattagtctgtttagagtttttatttcttcataattttatcttgataatttgtatatatcctgatatttatccatttttttctatattatgaaatttgtttagttgttcatattagtcttttatgtttatttatatttctatgttaacagttgtaatgtctcctttttatctttaattttatttgagtgttttctctttttttcttagtctagctgaaggctggtagattcttcttttcaaaatatcagctcatcatttcaatgatgttttgaaggatttttagtctccattttgttttctctgctccgagttttattatttcctttcttctaccaatttagggcttagtttgtgcttgttttgctagttccttgtggtattttagaagtctttcttctttttgaggcaggtgcttgtcactagaaacttctatcttagaactacttttgcgatgccccatggtttttggtatgatgtgtttctattcttctttttcatgggaattttttttaatttccccttggtttcctcattgaaccattggttatgatccagcaatcctaatactgtatatctccaaaggaaatgaaatcagtatgtcaaagatgaatctacactcccatgtttattgcagccctatttatgatagccaagatatggaataaacctaagtggttaaaaatggatgaatggataaaggaaatgtggcatatatacataatggaatattattctatcatataaaataatgaaatcctgtcatttgtaacaacatggttgaacctagagggcatcatgttaagtaaaataagtaagccagacacagaaagacaaacaccacatgatctcattcgtatgtgaaacctagggggtaaaagttgataatagaagtagaaagtagaaaagggagaggttgttcaatgggaataaagttataattaggtaagaagaatacattctggtgttctactacgcagcagggtgactatagttaacactaaggtgttgtatattacaaaacagctagaagaaaggcttttgaatgttcttaccacaaggaaatgataaatgcatgaggtaatgcatatgctaagtaccctaatttgatcattatacaagatataaatctatagaagcatcaaattgtacctcataaataggcacaattcccatgtgtcagttaaatgtgtgtgtgtatacagaaccagaacacttcacaccaatccactcccagctggttcaaaatactattgtcttttgtctgaatttcagcaatagctttttaaagggtctctttgcttccactttgcctccctgctcctttccccagtgtattttcaacataatagccagaatgatttatttaaaatataagtcagatcaagacactcttttgctcaaaatcttcctagacttttacgacagtgaaagccaaaacttttacaataacctccaagaggcttttatttctttaaaactgtctagctaatgagtcagaacatatgtgtcaacacaactcctggtctctgaagactacctaagaaaaaatgaaaccgtttacctccatctctgacagggcttgacctaatctcaagccagttccctttctgctgttgtttccttgcttctttacaaaatttggctttaaactaggatctccaagattcagaaaccaacttttcaacataggtgccacctggcattcacctgaaattctccaaaagttaggggaatcacctgatagtcacgtcaagagaggaaacaatgttgacttttattctaaaaccaaaagagaccattctacaatgttaggcctttatgtctatgcacagtgttcactttgccctaactgctttttctcgtcaaaatcctacccactatttaaggccgagtttagatgtaactgccttcctggatcctcaactaatccatccagtcaattgtggttgttccttcctctaccctctacccccataatttgtctttccagtttagtctgtaagtcattttccacacatcttaactcactgggtatgtctgctaagtactgatggactccttgaagacaaagttagtaagtgtcgctcattataacatttttttccaagcaaatagaaagtaggtccttcagaacttaaggatgaaagttgaaggagatggaagaaggcaatactttgctgcagagtaaagtaccctttcagagagatctggctatccctttcacatctccttccttctctctctcacatcaatgtattgacttcattaggatgttgaagtcataagctggctgggtgtgatgcccatgcctgtaatcccagcactttgggaggcggaagtaggagggtcatctgaagccaggagcttgaccagactggaaaatatgctgagactctatctctacaaaaaaatcaaaaattagctgggcatgatatcatgtgcctctagtcccagctactcaggaggctaatgcaggaggatctcttgagcacagaattttgaggctgcagtagctatgatggtgttactgcactccagctggaatgacagagcaagatcctatctcaaaaaagaaaaaagaaaattgtaaactagcctaatgattcccaaaaacagatttaaaagaattcttcagcagaatcatctgggggaacatttaaaaacatgtttctaagctacttctctggaagttcccagaagttcagattaagtggatctgaccaaacacctaggtatatgacacagtattaaatgatcaaaaattttagaaataatttgcttaagaccaattttaataattttaggggaagacagaggcttagatgatgggggaaaaataaaaaccgatatagaaagtatcacctcaatatagtacacaaaagatgatgtaatcagatgatgcaatttccaatgtaaggtcattttattttatttgttttgtcattatattcactaataatcctcaaataaaattttgagttatgcttaggtcaccatcatggaatggatatctgggcaaaagattacagtatcctttcctttagaagttatgcttctcagtgtaaattaataattgacatcctagtaaccatacatcaatctccatgtacttgtttactgtgagtttgttctaggagacacattcacagccatatatcaacaaagtcagctttctgaacctgtaaacctccaggtcttgagaggatcaagtatatgtttaccctattaaagactatatattagcctctggtaaatactccactacttttttctcattcatctttagttaatacatgagaaatgaaatgtagaggggatctggagtcctagacgtaagttttgactctgtgactgatttgctttataatatttgtcaacagtaattatcatttatgtgttctattattatgttccatacattgtccttgacatcttacacacatcatcctgtttaattatcctaccaaccctgcaaaaaaagacgtaatgtatggcaactatttctatattcctccacattagcaattctctcattcatccttagaaaaagaatcccaatttcattaaagggtattgatgcatagaatatatacaaaataattggagctctaacagctgccttggactgtagtgtgattttaagtatagaagtcacttgctaaggatgcagaataggaatagcttggattcctgatgatagcagaagccactataccttccctggcttttccgcctttgtaggttttttacataagaaggaaatatgcaactgttattttgggctttctttgtatattccaaacgtaacacaaactgctacagaattggatttattttaaattgaggaaacaaggtacagaaagattatttaacttaagatcacacaactagcatgtactgagcagcaatgcttggcctggcaatactattctaaaaccgaaattctttgtcatgttttatgacctcaaaaaagatattaatactttttatgctttatgttttgtacagaagaaaacttgtatctactgacactttttatgtgtcaggcattgtgttggctattgtcacaaggatatacattgccttgtgtatcatttaatctcaagattccctgtgtctaaaatttaagtgatatctaaaaatttagagataaaatatctcttttcatctctgtgaaactaaaaccaaaaacctctttgtacaatctagcagggaacacttgtcaatatgcagccaaacattgactaacgtattttctccaagttaggccagctccaccagagaaaatgatctcttcaactttgataaaccctcatatacaagattcagaacaagtgaacatcacacttgttattttcttctgattccttttcaaataacactgtaagtgttattattagaaccttaagacccattagaaacaggataaaagaaaatagaagtaactagctctcctactgggataagagatgaaacaagagagagaaagttttgttctccaaagcagcaattccacattatgagattacataaagaagaaacacacacactcacatatacaccactcaccacacacacacacacacacacacacacagagagagagagtgaaaggggggtggtggaggaacacagaaaaacagagcaaggaaaaaaattagaacattttggagggaagggttccagatggcagccaggatgagcctctgccacaaagatgaaccaaaatatcaggtaaacattcacacgttgaaaagattttttgaaagagaacactaaaattcaataaagaggcaacagaagacaccatgagtgaagagagagagagcagggctgcctgctcagcattgctgggtgccaggaccagcctccagacctggacccagatccaaggaagggatgagtgaaggaacctcagggcataacattcctgccatagacctctgagatcctagctacaggagagttccatgacccgtgtagacctttagactggcagacaaagcctgctcgtggtgatcttgagtcagggaggaacccccccactcagaacaaagagaaaagtgtagcacaggttcatgtagtggcatgggagatgggtacccctcccttcataagactagactgggaagggtgaggcctgatagccatggtttctgttcaagggagtctcacagcccaaaacacctggaatgactaagtgatctgaatgcagatagcttgagtctagcctaaccattttggcctgctgtcagcagcagaatgttggagggagacctgctgcaccaggggtgtgggagctgggccagtcccactgctgcctgctgggctgaaaaccccaggccacccaatttgccttaagcagactctgtggtacaggagaggcaactcagccccttggccccagctgcctgagagtctgcctatagccgtgccaggattggggcttgtgctcgcctcagagagcatggtcacaggtttgcctgtcccagccccacccagatttgcttcctccagctgcctgggtggcagagcacaggacaggaacccctggaaactccagggtccagcccattgccaaggatactctcgtacttcccctcattaacaaaggtcaagtaaaatttccacggccaccaccacaactacctcccgcctgcaagtgccacctattagcctgaaggtcaacctatatgtgtcatcacaacttctcctgacaccattatagagcactcaggcagctcatacttgaaagtgccacctacaggccagtagggtgaactgcaaaagccaatataattcctgctgacacacgtgcacagcactgaggaacaaagttccagagacctccacctcccatctctgtaagagacaacaagcctgctcacacatgtagtacactgttgctacaatctacaaacaaccagcatttaagaaaaccactacatgaaggccatctataaccaaggaatttatacagatctttggccccctaaaagcacaagaagcagagaaaaagaatgctactcaacatacacaacagtcacacactcaaagtggaaaaaatctcatccaaatgaatgtaaactcacagcttctctggaaagaattttggcaatggctattttcccaggaattaacaccaaaatttatatgcaaatatgttcattgtcttcttatttactgtgtgacctttggctttctcttaaaataaaagccacctttaatttataacgtttcattcctgtgaaaaatattaatttaacaaagtctgtgacaggttttcttgccttccataaatgatttagtaatactaaactcattaggggaaacatgaagtttcccaaaggtactacctgtaggtgctctaaattctttagaatgtgaatattctcatatgatgactaggacaagtgtctctctcattcattcattcatgcattcattcattcaacagatggtttatgactgcctactatgtgtaaggcacagtgctaggcactaatgatgcaatggtgaaaagaaacatgtagttgtcactctcttgggccatctaatccaggaggaaagataaatcaaataattacacaaacaaataagaaagcagcaaatgtaaagatatgttttgaatatcagctgtcagtcagggaacaggcaacataaaaaataaggtaataacaaatttttattttattgtgaacttagcagaaattttattttcacaaattttacagtcttggctttaactattccatgatatacttgaaaacctcttatacttagctaatgaatgaaccttcaccttggctttgttgttctctcttcaaacatttgaaaatttgtgaaaatctcgggacttgttcctcataaaccacaagagtttatcctacagtcagtgtttctcccaggattgacctatctggaaattaaggctttaactgcctttagtgctataagatcaggatttgttgtatttagggctatatcctctgcacccagtatctactatataatgagtgcccagtacatgattgtttattgattgaactgctgggatagtttgtttagaataagtaaaaggaggctcttagaaagtgatgcatgaccttgcctacttgtcagaaccacctggtgaacttaaaaaaaaataaaatccttgttgttctttcttggcaattgtgaaaaggaataaccagcataattttgatagtacctactgtcactctcaaagtgtaccaatttggttggtaaattatgtgagacagatatatatatatgcgtgaatattaaatataagaagacaatagaagtcaaaggtgggtgtcattggatgtacctctaccatacacagactttggagtcagacaaacctacattccaatccctgctcttctacttactagtggtaccatgagtgaagaaaaaaatcttacttaaactggcatctgtggcaagttactttacctcccaaagactcagtttcatcaactaaaaatgcaaataatattggtttcttactcataaggctgtagtgattattaataatgtgcaaagaatgttggtatggcacagagtaaacagcaggtgaataaaatggtttctccccagtacatacatgcagtgggttcccaactgtctttttcccttaagaaatgagacccacacccttgaaggagacatagataatggtttgcacatgacacacttaatgacttgtgggaaaatactttcatttcacatcactattttgttcaacatatctggattatagtttctttccaaataactagctgttgacttgaaggatgacacacgcacaaagccttctcgttattcaggaggaaacaagataatttaaatagtccaatttttacctctttgtagctttcttttgtgatttgtttggggatgttaaaaaggccaagttcctcagttgtagcctttcaataacatgtcagtttacattatctgtgagatgaactctacctcttatacaatgtctgcaagttttgccgcctaccagtgagaaagcaaaagacagcaagaaaaatgggatgtgctaggaacatctttcttcccaagccctgccctcctcaatctgcctaaacattctgcaaggattatttcttgtgagacaaagtccttgattcaggctcatggaataagtaggattgcgataggcaggaaagattccagagggaacaaagatatcaagatacagaaggactagatggatttaagaaaagtgaataatcagtctaatgaagatggagtataagtgatgtcaaggataaattgggaaatgagaactgaatgctgtgtggggtccagattatgaagagctttgaactctagattgagattaggtgctattctctaattagagtttgtggggaataggagacatattttctacttgaaatggacagctcttattcagatagggcagatcaactgcattctgcaatgcagttcagagcctataatcctttactttgggaggagtgtaaaagacagctagacatgtgggccatccagtgggccacatatgatgaaatgaggatatataggacagagcagtagcaggggctcccagtgcaagaatcaataggacttagtgactgattagattcaggaaattaagggaaaaacgaagtcagatgactgactgagattttcaggttggattgcttggaaaatgatgatgtcctgaaacactttagttgcagaccattttgacctaatgtaagccttaagtgggaatttattataaacagagtaacagctactagttattgaacatttacattgccaggaactattaagaatgcattatagctattatcttatttaccttctcttcatagtactggtaggtaggtactattttcatatgagcagagtattttcatatcaccagaggtttaaccaaagtcgcatagctgataaaggagaggcgtagcatttgaatccaaatagccctgtccagagggctcttaatcagtagtcaacattacctccccatggttaacattagcctcgcaaaataccaaacccttaaaaggaatgtagccagcctttaggaagggatgaaaagaaaaataggaaaacgggtggcaaataaagcagtattcagctttgatctctcagttctgcctcaccagccacctggtggagtatggcaaccagaggaacatggtaacccagagttcctgagtttacacagttgagttgtagcccccatgggtctctcactctttttatctcagttttatccttatttatactcttattctctatctaatgccaaatccctagaaaggaattgtgactgaagtgtgagtagatgcccaactcggtccagtcattagggtctaaggtccccactaacaacagctactggagggatcatctctgatataagaggcagttattccttggcaatgactgtaaattgcatagtctacccgactttttatcatcaaacatccttggacttgaaattgaaaaggcctaaacttagatttgtgttatacaactaccattaacaagtcacttgttctctctgggtcttgatttcctcgaaaataagatactcataattatgcttgcacagtctacctcacagggtgattatgagggccaaatggaataactgctttctagtatagctaaaattaataaagtgcttatcatgcatgagcactattttaagtgtttggtatattactgacattaactctatgcttgaccctatgatatagatgccaatttattcccatttcacaaaagaagaaactgagaatcagagaagataagaaaatgtgcccaagctcacacagctgtaatcaatacactataaaacatagcttttgagtctgtttttaaccactccttacatgggtatgaagggacctagtaacctaccaagcactatccaaacatgagaaattgttactactgtcaaccactgcatctaacagcaaaaaacaatgtttaatctaatcaaatgaaatatgattgggcgtttggatttttgttcctacaagattttagtgctctggttttgctctatttcagtctttgtagggaagatacatattaattttgtctttaatttatttcatgggagtcttttggaaaacatttggtttgactctcatgacaaatacgttgaaggctccatgataaattaatttgttgtgttcatttggttttatggctcatgaaatttgtgtaatttattgctgccttgggatgtcagtctcactcagttctagttccaaagtaaggtcctacagaaaaagaaaaggaaagcatgagaaaaatggtgagaatggctgagtcaaagcataaaaagccaaaatatctaggcagagggccagggaagggaggaaaatcttggtcacttcccaaaggagtatgttctctaggaagagatgttaataagtaaggccttatttatagcttagaaaaaaatgaagggaggtgtggttagaatatgttggggctcaaaaaatgttagtacaggacatttggtgtagctgggcattctaggagcaggggctagaaaccttagtaaagggcaagagtcttctccaggaggcccgccattttcgtaactcagtagttgtgtgtgcaacaaattcacctctttttttctacttccccctaattcagtttatcaatatatgtaaaccaaatgcaaattacaggttatctttttgcagcagttgagatagccaaactttgattcagatgtttgcttgggtctgataaactacaagggaagattcaaggtgcctacagtgtttacttagccaaaactatgtgcaagagtatattataggagaagagagtttgacttgggtagacacaccaaattatccaatatcattcactagtcctgactaattgtggacttacgaaaaagatacaacatagcccaaagtaggtagtttttcttcacaaagtttgagctcacttttgaaatttcagactatccaaataaacaataaaacatataaaactaaaagagaaattggtgtctaatgaaacacttcatggtgcagtaaatacagccagtgctgtacaaactcagagaaaaatgagcagcacagaagaaggttccctggagagcttgaatgtcacctgggcctggaaagattgctgggtttggattgggatcagtaaaggccattccatataggaaagattggaaaggggaggtttgattcacagatttattttaactgaaactctcttatgtgccagatctcatagttgaatgggcttgagtgttccataagttcctgactaatgaacagttggagagtctgcataaataagagagaggtattaagtaacagtaaaaggtagaaaattgagatgggaccatattatagaggagcttgaaagccaggtgatggactttcagagacaaaactattaaaggagcttaaattaagaaatgttataataaaattgacatttaaagaagatgaattgagctgaaatgtacagccaggaggcactaaagacaaccaaaagaatatggccacagactaggtgtgaattattgaggacctggtccgagttgttgctagagcacagagaggaaaactgacatgaatgattgtcttagtccacttagactgctgtaacaaaatgcctttgatgcagtaatttataaatgacagaaatgtgtggctcaaagttctagagactgaggagtccaagatcaagatgccagcagatcagtgtctggtgagtgcttgctttctgcttcatagacagccccatttttatttatcctcatataatacaaggggcaaacaagctgttgggcctcttttatcagggcaatgatctcgttcatgaggactccctggtgctctactctcagagcgtgacttactctgtaggtgaaaaacatacaagcacttgcttcccttggtgtggggtaaaatgagactggcattcgtcctaggtaactgggcattgtccccatttctctcacctcctcagccagggccattaactcagtgtggcagcttctgttgaaagaagccccagttagtaaaacactgtgccaataaaataatcatgtactctaggggaaacagccagctgttacgtgccatgctggagtgcttttcaatttggagacaaccatccttttcttaacaatgactgccaagtacagatttgtcattcactgaagacgtgaggaagcttgatattaagacctgtttctttgtgtcctttcaaaatcaggtgtaagaaatgagaaagtcagggaaaaaatagaaaaggacaagaaaataaatggcctgactatgtcattcatagagttataatgagggctttacaagtttactacttgctatcatcatcaggatgattcagcgtttcagaagatactcaagtatactcttttcccaatttccctgtctctaacttacacatcacctctagctccagcatgaagatttcaaaaataccacttatgtattctcttctgtctttttcctttaggacattgtttctatgatctgaatgtttgtatgttaccaaaattcacatgttgaaaccccagtaaataatattcagaggtggggtctttgagaggtgactagcccaccttttattagcctgtgcccaggatcattaggatcagctctctcacctggctctgctggtggttgctgactgcatgctgactttcctctgcactgctacactccttcctcagcaaactctttgaacacacagcctctgcagaaaaatgctttttgcttacactccctatagaagttttagaatcttctcttcttaccagtatccccaggcttccaaaagaggtcattcttactacttcctgggtttgtgctctttgaaaggccaacccgaaggaggccccaaattaaaacatatctaaccatatttttaaaagttaatagccaattagtgttaatttcatgtagcatcaagcacatagttttctaacaactttctattaaatataataaatacagaaaagagtacataccagaagtgtaagctgaacacagatgaaaccaacacacagaagggccccttctgcttcctttctgcctctgcctccgcctctcccaaagactaaccactctccttacttctaacatcctatatgggatgtgtctttttctatgctctctataaatggaatacaatttatactatttgtatctggcttctgtcactcaacattatgtttgggaaattcatccatatggttggagcacttgtagattgatcactcttattgctgtttagttttgtgctctcttgatttgcttagttgatctcagaaattatgaaaatgactcacttctaaaagttagaattccacataagcaatgtctttggggaaaagaagcctaaaagtatataactcgttaggatttataggccatttgatccaatatttttcaaacatttttgcatccaacccttagtgggggtgcaaccacagacaagtcaactgaccttatctgtaaaatagagatgatacctactccagagagttgctacccagattacatgatgtgatatttgtacaaatatccagcagtatgcctgacaaacagtaagaactcaagtttttttatattttaaattgaataggtagttgtgtttctatgaccaacctgaagcaagacttgcagccatcgctgtaaactagcagtcaaaagctggggggctacatggatgtgttatacagacaattgttcctcatttctgaacacctggattctattactaacctcccctcttcctacctaaagtactttaaggcttaaccattttagcctcaatggtctcattagttaaatgaggatattatatgtgtgtgtgtgtgctcttgtgtatatgtgtatatatatgtatgtatacctatacatctcatgggattgttgtggtaacatactatattcagaggtactttgtaaaataaaatattttaaagtccaaatgacgcatattgctatagaaaagaccatgaaccacctaacagttttcacatcacaattatcatagagaaaaagcatcatggtatcacttaggagagaagtgaagaggttttaattagattcttaatagctacacattgtagagaacctacaatatgccaatcactgctaaacactctacaaacacatacactgatttcctaattcctcacaatgaccaggatttagtattactctctttctcacatgaggaaattggggttcaaataagttaagcatattatctaaggtcacttggtaatgggtaagaccaaggcacaagcccaagtttgtctggctccaaggcccatactcttggcaccacatggcactgcctcagcaatgtgaaataacagatgctgcccaaattaaaactgcatggagttatgattagcacattggcatgggctcttaagtgggcaggacagatgctgaaactaggcagaagtaagtgtaccaactgatgggaaccaggacaaacaatcaaagaacatgcctatgaaaaaaaaatctgttgctcccagaatgttaaaacatttttgtttaaacagaatcctcatgtccttgttatgaggaacagtcagagatttagtgaaatattctcagtgagtcaatcaggaatgctgttaaaagttacagtgtgcctggttctgggaagactgcataggtataacgtgatctttaaatggaatttatttaaagtgtgatccttcagtccatccatgtcccttttggccatgcttttaaattgcttataaacatgtcacacagattgttaaaggaaacacacaggaaactttcaatcttcttgggtaatatgatcatgaaatacctcagggaaaaaaagtacagatgttttatttggaaattgtgttctttctttttaataggagtagaactacagcaactttgttaatttacctaaggttgaatttgaaaggaatagagaatgtagtcagttctgtccttactacctggttaaaaagtcctttctgaaaataccatcaaaatggacatttttaaaaaaatgacagagatcctctaatacaatctgtgttgcatctcccaagtaaatatatgaaggaagtaatttcctatccttttccaaatattaattcagccattttgtgttttgttctaatcataaacataatgtattctttcaataaatattttaaatgatgccaaaaatgatgtagaaaaaaatgtcattacgcatacgtgaacgttgttagaacttagatgaacattctttcacagatatctcttctctgtctctatttctttttttcctctctcatgcacacctcacacacatctgtgcatatgcatacataatcttacataaataaaatcaaatacaatgaacattttattaatcttcttctttgaacatttccatagatattttttccaaggtttccatcatcatgtttagtggctgcttagcattttattttatggatgataaggcagacggatagtattgattaaatatcctggaatcagagacagcagtttctgtcaatacataacaagtccctttctctcataagatcttaagttccttacttgtaaaaaaggtgactgaagtaggtggtttacttaacaccggcattccatagaggagtattctatatcctaaatggaattgttctttccattttcatgggctccatcttccctataccctagaattatttacatacagtactataaatgaggtgctgtgatagcacaagaagagagagcaagagattacttaatttaaaactcaaaatatgtttgtggaggagagctttaaaagaggaacttgattttgaggaaccagtagcactgaatatgtggtatgacatagaaaaggcattccaaagcagggaacagcactgatacaaggtactgaggcaggacagagcactttatcagatgagactgatcaaaggagctacttgaaggaaagtgacaatagctggtcgggatcatattataaaggaaaggcatatattgggagaattttgagcggaggaaggaaaggggtaggtaatgagagtgtctgaaggttttaagcgggaggaagataaaataataagaacaagataattttttgtgtgtgtgcttcccttccctccctttacccccttttccctttttgatggtttggaaaaggagagttactagatgcaggaaagaccatctgggctattaacaaagctgaatcatgttggtagtactacaatgggcaggcagcagaaggcaacacaatgcagtcactaagaccctttaggaccagagtacctggttttgaatgctttctcagggttaaatagctttgtggccccagagagttacttgattaaatatgttaatgtctgcatatactgagccctatacgtgtttgattaaagtattataaagatgtgatgaatgcaagagacatttcacagataaactcagtgggacatttaggggaaaagctttgatgctgtgagacaaagaaagtaaagatgattccaggttactaagaaggagcagaaagagagctggggaacaagggggcagcaggtttgcacagggagactgactggtgtcaggtttatgctaggtagattttgaagtacaaaaaggaaattcacaaaaaaaaaatatgcaactgaagatttgaaacagaacatggcactcaggaacccaagtagaggtatagattttggagtcatgagcttcacatatcatttggagtgattgttgggttgagatgtggtaagatgataattctaggcttacaagatatatcacatgtatttatcctataaatatatctaatatgtgcatagaaaattatcattttaacattggtcctgtataacgggaatccatttgtaacataacttaaaactctgttattacctccaagtaaacattgatgatactgtgtttctcacacccaaccagtctgttaatataaattccaaatgattttttcaacagcgctgcataaaacagtgacaaatcctctacttaatgagcctcaaagcaattaagacacaaatacattggagaatcccattgcatttaatcatcagaaaaagaataaacaaaaatgcactctgatgatgaaataaattttacaaatcaattataatttaatttcctgaacagattttgaaagccacagatctctgatatgacatagttataggttaattgttaagtactgacagaattacaggaaaataatgggaaaagtacttggccaggatttagaaaaactgggtttttgtgctcttcaactgtttttatgactttggtcgaatcattatgcttccctgaacctcagtttccttatttatcaaattccactaaaaatatcttttctgatactatgatgaaaataagaaagatactgcaagtagaaattacagtagtcctcccttactggtgataatgatttttttatggtttcagttacccttggtcaacctcagtccatactaaatggaaatactgaacggaatactccagaattccattctaaatggaacactccatttactaaatggaatactaaatggaaaactccagaaataaacaattcatacatgttaagttacacgctgttctgagtagagtgatgaatgaaattttatgccgccctgctccatatcacctgaatcaaacctgtccagggcatccatgctctatatactacctgaccattagtccctccgtcaacttggttttcacatagaaaaacatagtgtatatagggttcagtggcttcaggcatccactagggttttgaaatgtattccctgaggataagggaggactactgtattttaaagtctgctgaccagttttgctaacacatgcaggtacaagtttagattggtctttggcagttgcggcaaagagagtggccctaagtgccaagaaatcccgtcacagtttccttatcacgtcgatgtgtttaacttatcgttcatcacagtctggacctcagctttgcaggctcagcacaaggagggcaggtccatttctcagtggtagactctaatatatacaactgaataaaatgggaaaaaaacaaactttcaatgttctaatctgtaacaagatacaataatccgagaatttaatacttaaaatagaaattccatcactttttctctcttctgacaaactttcatgagaagaaaatgtagactgtgttatttaaaatatggaattaaagatgtgaggaattacagttggtcctctaaatctaagggttccgtagccacagatgcaaccaactgcagttgtttggggaaaaaaaaaacaacaaaaataacaatacaacaataaaaataatacaacttttaaaaatactgtataacaactatttgcatagcatttacattgtattaggtattagaaatcatccagagatgatttaaagtacataggaagatacggatagtttatatgcaaacactataccattgtttataagggacttgaacatctgtggattttggtatccatgagggttcctggaaccattcctccatgatactaagggatgactgtacatagaatcagaagtgtaactgcatgatactatatgcaaacctgttataggcgcctcataatagaggaggtcctgtcttggcgtaagacttctactcccttggatggcattagatggctgtggcccaaatttcacatctgtgattttacttgtctaaactttagtgatagaacaaacaccattctaagagctcacctttgcaatcacggtttactatagcctcaaattccgaactcctgggttcaagcgatcctccagcctcagcctcctgagtagatggaactacagcccaaataattttttatttttatttttaagagaatgaggtcttgctatgttgtccaggatggtctgaatctcctgacttcaagtgatcttcccaccttagcctcccaagtagctgggattacagacatgagccactacgcccagctagacaatttttaatatgtatctgagtcgggactatccaaaaaaacaaaaccaataggaaaatatacatatatatacacacacatttttacatatatatataaagaacttcatatgcaagatatttttatacatttatatgtttatatttatatattatagatagaaaacagtaaatatatattatatatgtaaaatatataatatatatttatgtatttgtatagttttttaatataaagacatgcgtgtctatatatgtaagatatatagataagaaactatatatcttacatatatagatacatatgtctttatacataaaaatgtttatgtatatatgtaaatacagatatatatatctttatatatataaatatctttaaaagtatatgagtaattattgagactgagaagtccgagatctgctctctgcaagctggggcccaggaaagtctttgttgtagctccagtccatactggaaggcctggggactaggggagccaatatcgtaatgttcccgtccaaatccaatggctggaaaccaggatcaccaaagtccaagagcaggagaagatacatgtcccaacttaagtaaagagagcaaattcacctttcctccaccttttagttctattcaagccctcaacagattagataatgcccacctgcactggtgagtgcagatctttactcagtctatgcctagactcaaatgctaatgtcttctggaaagatcttcacagacaaacccaagaagcatgctttatcagctatttgtttaaaaacttaactactaataccctactattgaccaaaacccttactgataacataaacactgattaactcatatttgtatgttatatgtattatatactatataataacaataaagtatgctagagaaaaaaggttattaagaaaatcataaggaagagaaaatacatttttagtactgtactgtattaatcaacaccataagttcatgtcatctgtttacaaaatgaattgtctgaagtggccgccaaatgcagctggcaactctgtcaagttaacatgtaaaattaaccatcataacaattgttatgatactctctgcatcttctagattttaaggtttttgtcaaagagttgcacataatattcttatatgtgtttgcttcaatttcatgaggaaatatatctctggatatacagttgacccttgaacaacatgggtttaaattgtgatgtccacttagaggcagacttttaaataaatacattgaaggggtttttaaagatttgtgacaatttgaaaaaacttacagatgaaacatgtagcctagagatattgaaaatattaaggacaagtgacgcatgtcatgaatgtatatgatatatgtagataatagtctattttatcatttaataccattacatacacacaaatctatcataaaaagttaaaatttatcaaaacacacacaagatcactcacagaccatacatggcaccatttgtagttcagagaaacataaacaaatgtaaagatgcagtattaaatcataactgcataaaattaactgcaacacatactgtaacactgtaaaaatttcatagttatctcttgttgctattgcagcgagcccgtgtcctgagtattcacttaaaataccatgtgacactagtcatcacataagcatattgcctctccagcaaattatgtatcacagtaaagactgatctcctacagttctcagaaatttttcattgtgtttattgcaatattgtaaacgttgaataaccacccatggggctcaacaacgtgccactaatgaagttagaactcctgagaagcagagaaaagtcatgacaaacaatgaaagttgaattgcttgttatataccgtagagtgaggtctgcagctacagttggcggctaattcagacagatggttcatcttgtaaacagatgacataaacttatgattttgactgatacagtacagtactaaaaatgtattttctcttccttatgattttctctagcttactttattgtaagtatacagtatataatacatataacatacagaatatgtgctaatgagtgtttatcttatcagtaaggcttccggtcaatagtagggtattagtagttaaggtttttggggtgtcaaaatttatacatagattttcaagtgtgcaaaattttggtgcccctaacccccacattgttcaaggttcaactgtatatatttttttcattcctaatttcaactgttttttttttctctcactgtttcgcttaagcattatatattttactggccttttcaaatgacaacttcagaattcatttttctaatatatttatttttaattctgttaatttgaaaagttattgattatgctagttatattttggatgatttttaattgctttatcttctaaattagcgttatacatattagatttcttgattttagtctttttgttctttaataatgaagatattaaaagtatgcatttttggccaggtgtggtgactcatacctcaaccccagtattttgagaggtcaagccaggtggactgcttcagcccaggagttcaaggccagtctgggcaacatggcaaaacccatctctatcaaaagaaaaaataaaaaataagtagctgggtgtagtggcttgcacgtgtattcccagctactcaagaggcctcagcagcagattgattgagcccctgaggtccaggctgcattgagctgtgatcaagcagctgcgctccagcctgggtgacagaggccctgccttaaaaaataataataataacaaaataaaattatgcatttttttctgttaattgctctagctgtctcccatgggtttggtttgaagtgttcacattttgactttttacaggaattaagtaatttgatttttatttctaccatgttctaaaggttacaagtacttatgttattttattatttatttccaatatgttagctttctatcagagaatgctttttctacttttaaaaaattaaatatgttttatagctaagtacgtgactacatatgttagttatattaatatgtaaaaatgtatgtgttctcttgaaaggatgaaatgaagcatctgtaatgtgctggttacttctatgagtactgcagaaaaagcagagaacacaacagacgaaagtgtctgactctaaggatcttatattctaatttacagaaaaccacaataatatacaacaaataaagacaacatgtattaacttagaaggtgataagttgtgtagtattagaaatatttaataactggtagagatatagaaaattctaagtctaaaacattaaaatttattctctaagtgaaatactaaatgatacaagctgtaggaataattatcaattagatcgttcttgtaatttcaaaataattagtttattttagaaattggtggtgggtgttttttgattgattcagctgttagataaatgcctttttctgtgtcacattttgacagattttaacagagagcaccacatttgtatttttaatgaatacttccattaaagatgtaacctcaacaagttaaaaaaaaagtgtcttaacaaagataacattgttcatagtgctgaatcctctctgagtatctgttaaacaataattacattcaaaatgtttttatactcttttagtattacatgagagtttaatatattcagtctcaaactatagtaaccaaaacaatgtgacacaagcaggaaaaatagacacacagatgattggagcagaatagagaacccaaaaataaatccacacatccaaagtcaactcattttcaacaaaggtaccaagaacatacattggtgaaaggacagccttttcaataaatggtgctaggaaaactggatattcatatgcagaagaatgaaactagactcctatgtcttgcaatattaaaaaaatgaattaatgacttacatctaattcttgaaactgaaacttctagaagacaacaacattggggaaacactccaggacattggtctgggaaaagatttctcgagtaaaacttcaaaagcaaaaatggatagaagggattcacatcaagctaaaacacttctgcacagcaaaggaaacaatcaatgaagtgaagagacaactcacagaatgggagaaaatatttgcaaactacccatctcacaagggattaataaccaggacatataagaagctcaaacaacttaataggaaaaagtaatctaatcaaagggcaaaatctgaatagtgatttctcaaaataagacataccaattgccaacagatatgtgaaaaatgcttgacattactaatcatcagggaaatgcaaattgagactacaatgagatatcatctcactccagttaaaatggcttttatccgaaagacaggcaataacagatgctgatgaggatatggagaaagaggaaccctcatacactgttggtaggaatgtaatttaatacagtaagtatgaagaacagtatgggggctcctcaaaaaactaaaaatagaactaccatatcacttagcaatcccataccttgatatatattcaagagaaaggaagatgatatatcaaagaggtatctgcactttcatgtttattccagcactattcacaatagctaagatatggaagcaacctgtgtccatcagtagataaatggataaagaaaatgtggcatagttagacaatggaatattattcagccattaaaaatgaaatactgtcattcgcaacatggataaaactggaggacataatgttaagtgaaataagccaggtagagaaagacaaatattgcacgttcttgctaataaatggaagctaaaaaaaaattgaactcagagagagagtaaaatgatgtttaccagaggctggaaagggttgtagggagaaagcgagaaaatagggatggttaaagagtacaaaaaatgcagttagatagaagaaataagatctagtatttggtagcataatagggagattacagttaacattaactcattgttatactttcaaataacgaatgagtggaattggaaagttcctaacataaagaactgataaatccttgaggtgatggatatcccaattatcctgatttggtcaaaacacattgtatgctattatcaaaatatcacacgtaccccaaaaatagggtacaatttgataaaagcataccttatttgggggtacatgtgatattttgatacaagcatacaacgtgttatgtgtccataataatttaaaataacaaattaaaaacatatattccatctctctactttttactaaatgaggaaaatcatttattagattttgttaagtatttactagaatgtgattttgttatcttgattttattactatttttgtactgctatttcataatgttttgcacttatcattgcgccaaatttcaggactcaacaagttgaaaagaatggaaaattttattttgactttcatctttatcatcttacaacaagcgcattatcatataacttgtagacaatctcaatctaagcctttagaactgttactttgttttgcttcaaggagtatattatgtttcttcatttctagtttcacttctcttttatgaatcctttgttttgttttatacattcaattacttgaactgtttatctaattaatctatcagctttattagtgatacgtcttttatgaaaggaaagggaatactggcatctctgtcaaatatatcatttagaaaaaccaaacctagctaaaaaattaattttcaaatatttaatgatttccattttataacttccattaaggtaaatatctaagacctgatacaatttacaaaccatttctgcagctagaacacaagagatgccaatttggctgtcataaatattcttccaatttacaatttctaattcctcagacatactatttaattcaccctgatatttatgagttgactagaagtaaatataaaatgtactgagaaaatataattttaaattgattaaaatgacttacctaattattgcattgtccagaggaacttttatttggagacagtaccaatgaaaacatcaaaaaatgttcaaaattttggcgaaactctagtctctttctttagtattatattataccatctgcatgaagatttaatagttttcaaagttctcagtaatccctcttttctcagtcataaataataaaactacatatattactttatataatgtctataacagtccacaagataagcataaaccacaaaaataattcagtcatgaattttacattttaattttttaaatgagtaaaactgttgaatagttgaaacactgttgatgattgaatttttaaaacatttttgaaacagtacacagaaaagtacacaaattataaatttgtagctcagtaaattatcataacagaatgatgttactgacatttctgaaagtcttccctgactctccaacatgaaacagaaaatccaccctcaacgtctcccaacaaccctgcttcatttttctgtatgacactcactgccatctgacgcagaatatatttccttctttatttgcttagattcttaaatttgccatctaagtctacctgcttccagtcatactgtcttggttcttatgttctcagaacttcattttaacagttcagtactgaaatagccacactgctttttgttgttgttgttgtctttataaattaagacaatttcatatcatttggtaactaatagaattgtaattgtgctaaacagcaagattaataacaaagtattatattcatttcattggtttacactgattcttttaggatgccacagaataccactggggcattagattgctatcatggcagcatctgccaaacagtcatggttctgtcgtacagtgggcctgagttatggtcagtcacaaggctaatctgaggattgtttatgaaacactttgtgctttagaggaaggactggtttatcattttcctccaattatgttttgactaatacttccgcatttcaataatcttctaaatctacgggagaaaaaagtacatcgacaatgaaccacagtctagaattttttttgatagtgtgcaaaagtcagaaaagcctggaatatcggtgatgtggaagagtcagaagaaagccaaattgactatttcaaccaaaaaatatcaatgagtgacatattattgcttgaaacataaaggtttgatgaaaatgacactagaaaattgtaacacaaagcctaaatgtttgaggagatagatacctcacttcccctgatgtgattattacatattgtatgcatgtatcaaaatattccacatacctcataaatatacatgcttactatataaccaaaaaaattaaaacataaagttaaaaagaaatatttgtcattaataattgaaagtgctaggtatttacatatttctatcagaatggtactcatattctgcctaaagttcatggttcaaataaagaacatatacaattatcaatgaggaaaatctcttaaaagactgtgaaacgatttcatattaaagcaattaaaaatagaaatttgggaattatttttaatcagagtgtttataaagaaacaaaacaggtatatgatttttgggacactagccaagatggctgaataggaacagctccagtctacagttcccagcatgagcaatgcagaagacgtatgatttctgcatttgcaactgaggtgctgggttcatctcactgggggttgtcggacagtgggtacaggacagtgagtgcagcacaccaagcatgagccaaagcaggacgaggcattgccttacccaggaagcacaaggggtcagggaatttgctttcctagccaaggaaaggggtgacagatggcacctggaatactgggtcactcccaccctaatactgcgcatttccaatggtcttagcaaacggcacaccaggagattatatcctacgcctggctcagagggtcctacacccatggagcctcactctttgctagcaaagcagtctgagatcaaactgcaaggcagcagtgaggctgggggaggggctcccgccattgctgaggcttgagcagttaaacaaagcagacaggaagccagaacgggatggagaccaccacagctcaaggaggcctgcctgcctttgtagactccacctctgggggcagggcatagccaaactaaaggcagcagaaacctctggagacttaaatgttcctgtctgacagcttttaagaaagtagtggttctcccagcacgcagcctgagatctgagaatggacagactgcctcctcactaggttgctgaacctcgagtagcctaactgggaggcaccccccagtagggatagactgacacctcacacggccgggtacccctctgacaaaaaacttccagaggaacgatcagacagctacatttgctgttcaccaaaattcgctgttctgcagcctccgctgctgatacccaggcaaacagggtctggagtggacttccagcaaactccaacagacttgcagctgagggtactgactgttagaaggaaaacgaacaaacagaaaggacaaccacaccaaaaccccatctgtacatgaccatcatcaaagaccaaaggtagataaaaccacaaagatggggaaaaaacagagcagaaaaactgaaaattctaaaaatcagagtgcctcttctcctgcaaaggaatgcagctcctcaccagcaacagaacaaagctggatggagaatgactttgatgagttgagagaagaaagcttcagacgatcaaacttctctgaactaaaggaggaagtttgaacccatggcaaagaagttaaaaaccttgaaaaaagattacaggaaagtctaactagaataaccaatgcagagaaatcctgaaaggacctgacggagttgaaaaccacggcatgagaactacatgatgaatgcacaagcctcagtagccgattcgatcaactggaagaaagggtatcagtgatggaagatgaaatgaatgaaatgaagtgagaagagaagtttagagaaaaaagagtaaaaagaaatgaacaaagcctccaagaaatatgggactatgtgaaaagaccaaatctatgtctgattggtgtacctgaaagtgatggggagaatgggaccatgctggaaaacactctgcagtatattatccaggagaacttccccaatctagcaaggcaggccaacattcaaattcaggaaacacagagaatgccacaaagatactcctcaaggagaacaactccaagacacataattgtcagatttgccaaagtcgaaatgaaggaaaaaatgttaagggcagccagagagaaaggtcaggttacccacaaagggaagcccatcagactaacagctgatctctcggcagaaactctacaagccagaagagagtgggggccaatattcaatattcttaaataaaagaattttcaacccagaatttcatatccagccaaactaagcttcaaaagtgaaagagaaaaaaaatcctttacagacaagcaaatgctgagagattttgtcaccatcaggcctgccctacaagagctcctgaaggaaccactaaacatggaaaggaacaactggtaccaaccactgcaaaaacatgccaaattgtaaagaccatcgaggctaggaagaaactgcatcaactaatgaggaaaataaccagctaacatcataatgacaggatcaaattaacacataacaatattaaccttaaatgtaaatgagccaaatgctctaattaaaagacacagactggcaaattggataaagagtcaagacccatcagtgtgctgtattcaggaaacccatctcacatgcagagacacacatatcaaaataaagggatggaggaagatctaccaagcaaatggaaaacaaaaaaagacaggggttgcaatcctagtctcggataaaagagactttaaaccaacaaagatcagaagagaccaagaaggccattacataatggtaaagggatcaattcaacaagaagagctaattatcctaaatatatatgcacccaatacaggagcacccagattcataaagcaagtccttagagacctacaaagagacttagactcccacacaatcatcatgggagacttcaacaccccacttcaacattggacagatccacaagacagaaaggtaacaaggatatccaggaattgaactcagctctgcaccaagcggacctaatagacatccacagaactctccaccccaaatcaacagaatatacattcttttcagcaccacatcacacctattccaaaattgaccacattgttggaagtaaagcactcctcagcaaatgtaaaagaacagaaattataacaaactatctatccgaccacagtgcaatcaaactagaactcaggattcagaaactcactcaaaaccactcaactacatggaaactgaacaacctgctcctgaatgactactgggtaaataatgaaatgaaggcagaaataaggatgtgctttgaaaccaacgagaacaaagacacaacataccagaatctctgggacacatttaaagcagtgtgtagagggaaatttatagcactaaatgtccacaagagaaagcaggaaagatctaaaattgacaccctaaaaacacaattaaaagaactagagaagcaagagcaaacacattcaaaagctggcaggaggcaagaaataactaagatcagagcagaactgaaggagatagagacacaaaaaacccttcaaaaaaatcaatgaatccaggagctggttttctgagatcaacaaaattgatagaccactagcaagactaataaagaagaaaagagagaagaatcaaatagacacaataaaaaatgataaaggggatatcaccactgatcctacagaaatacaaactaccatcagagaatactataaacacctctacacaaataaactagaaaatctagaagaaatgtataaattcctcgacacatacaccctcccaagactaaaccaggaagaagttgaatctctgaatagaccaatgacaggctctgaaattgaggcaataattaatagcttaccaaccaaaaaaagtccaggaccagatggattcacagcctaattctaccagaggtacaaggaggaactggtaccattccttctgaaactattccaatcaatagaaaaagagggaatcctccctaactcattttatgaggccagcatcatcctgataccaaagccgggcagagactcaacaaaaaaaagagaattttagaccaatatccctgatgaacatcaatgcaaaaatcctcaataaaatactggcaaactgaatccagcagcacatcaaaaagcttatccaccatgatcaagtgggattcattcctgggatgcaaggctggttcaacatatgcaaatcaataaacgtaatccagcatataaacagaaccaaagacaaaaaccacatgattatctcaatagatgcagaaaaggcctttgacaaaattcaacaactcttcatgttaaaaactctcaataaattaggtattgatgggacgtatctcaaaataataagagctatctatgaaaaacccacagccaatatcatactgaatgggcaaaaactggaagcattccctttgaaaactgccacaagacagggatgtactctctcaccactcctattcaacatagtgttggaagttctggccagggcaatcaggcaggagaaggaaataaagggtattcaattaggaaaagaggaagtcaaattgtccctgtttgcagatgacatgattatatatctagaaaaccccattgtctcagcccaaaatctccttaagctgataagcaacttcagcaaagtctcaggatacaaaatcaatgtacaaaaatcacaagcattcttatacaccaataacagacagagagccaaatcatgagtgaactcccattcacaattgcttcaaagagaataaaatacctaggaatccaacttacaagggatgtgaaggacctcttcaagagaactacaaaccactgctcaatgaaataaaagaggatacaaacaaatggaagaacattccatgctcatgggtaggaagaatcaatatcatgaaaatggccatactgcccaaggtaatttatagattcaatgccatccccatcaagctaccaatgactttcttcacagaattggaaaaaactactctacagttcatatagaaccaaaaaagagcctgcattgccaagtcagtcctaagccaaagaacaaagctggaagcatcacgctacctgacttcaaactatattacaaggctacagtacccaaaacagcatggtactgttaccaaaacagagatatagaccaatggaacagaacagagccctcagaaataatgccacatatctacaactatctgatctttgacaaatctgagaaaaacaggaaatggagaaaagattccgtatttaataaatggtgctgggaaacctggctagccatatgtagaaagctgaaactggatcccttccttacaccttatataaaaattaattcaagatggattgaagaattaaatgttagaactaataccataaaaaccctagaagaaaacctaggcaataccattcaggaaataggcatgggcaaggacttcatgtctaaaacactaaaagcaatggcaacaaaagccaaaattgacaaatgggatctaattaaactaaagagcttctgcacagcaaaagaaactaccatcaaagtgaacaggcaacctacagaatggagaaaatttttgcaatctactcatctgacaaagggctaatatccagaatctacaatgaactcaaacaaatttacaagaaaaaaacaaacaaccccctcaaaaagtgggtaaaggatatgaacagacacttcccaaaagaagacatttatgcagccaaaagacacacgaaaaaatgctcaccatcactggccatcagagaaatgcaaatcaaaaccacaatgagataccatctcacaccagttagaatggtcatcattaaaaagtcaggaaacaacaggtgctggagaagatgtggagaaataggaacacttttacactgttggtgggaaggtaaactagttcaaccattgtggtagttggtgtggcaattcctcatggatctagaactagaaataccatttgacccagccatcccattactgggtatatagccaaaggattataaatcatgctgctataaagacacttgcacatgtatgttcattgcagcactattcacagtagcaaagacttggaaccaagccaaatgtctaacaatgatagactggattaagaaaacgtggcacatatatacaccacggaatactatgcagccacaaaaaatgatgagttcacgtcctttgtagggacgtggatgaagctggaaaccatcattctcagcaaactatcacaaggacaaaaaaccaaacactgtgtgttctcactcatagatgggaattgaacaatgacaacacatggacacaggaaggggaacatcacacactggggcctgttgtggggtggggggaagggggagggatagcattaggagatatacctaatgttaaatgacaagttattaggtgcagcacaccaacatggcacatgtatacatatgtaactaacctgcacgttgtgcacatgtaccctaaaacctaaagtataatttaaaaaaaaagaaataaaatatactcatatgtaaagagccaatatatactagcattttcagacacaatatttaacatttcaaagatactaacatagatatgaacatattgcaatccaagttaatagttttggtattatattctgaagtttgtttatttaaatttaaatcagcttttttatttagtatttttaagtggaaaaatacaaaaatagagaacagcgcataaaacatatatttagagcaaaataaacaattataaattaaggatcatatctaggtcaagatatataaaatagtcagcataccagagtcctcatctatattttctgatcatattaattttccttagccctagcgttaactgaaatcctggcttttaccaaaaactttagatgttctagttgtttttatttgctccagtttttatttttgcaatgatagcaaaccaccctacacttagtggcatagaacaacagtcattttgttatgttaatggatcctgtgggtcaggaattaagcaaggacaaaaaaagaacagggtaatccccacttcataatatatgggggtctcaattggaaagactcagagtgtggggtgacttgaaaattggaatctgaaatatctaagacccattcattcacatttctgattatttacgctggctatctgctgggacattcactggcccgttttgccagaacacttatatataatatcttcatatgattacttaggatctctcaaagcatgtcagctgggttctgaaagtaaatgtcccaagagaagtaggtagaagctatattgctttttataaccttaccttgagagattcatttcagccataatgacaagctaacctagaatcaaggagaagcaacatctctcaatggaaggagcatcagagttatgctgtaagaatatcacatctgatttaatgcagtcatcatttgaaaagacaatctgccataatcccttcactgatcacaattaatatatttcccacatgcaaaacatacacagcctctctcgccaagaccctcgagtcatcccattactgcattagctcaaagcccaggattttatcatcttaataaggtccacatacggattagattcttcaggtgttgttcctcagttataattcctcgagtattgttgttttttatttgaaaaccagtgatctaaaaagacatgttgtctgccattcttgtatcaacatgcaatggagaaacaggcatagaataactgttaaactgttacaaaaactcctgttcaaaaaaggggaaaacaggaagcacacaagagttaccactccatagaagttctgaaatcacacgttgcttgttcctattaggcttcagtaccactacttggaagatgttttctggggctcttggttttacctctcaatcatacaccttttacataatacatcacctgtgtttgtaactgagaagtttcctcagcctgactgctggaaattggaatatgaagttccaaaggcctttttctttcattttgtgtgctctctttctctgtctaaaatgatgaagagggaagaggaggggaaggggagggggagggggaagggaggggaagaggaggggaggggaaggagagggggagggggagggggaagggagggggaggagagggggaacagagagggagggggaggggaagggaagggaagggaagggaagggaagggaagggaagggaaggaaggggagttgtggatttcttgtgtgtgaatttagtgaatatgtaagtcatgtcatcagacaaaagctgtacctaaaaaaaactttttgagataagctcttctccaccttatcataccataagacctctatcagacaatgccttcataatttttagaaaccctactggagaggatcttcaaggcatcccattcagagggtctgtcggtctcaaaggttctataggatatcaccttgcatcattttgcagtcttaacaaatgatcccgcagctctacgctaattctgatctttaactagaacccatttcttaaactcagaattgcttgatttttggagaagttggaaatgatatacagttacatttttgaactatgcaaaccctggctcattaagacttgtttttttttttttttaggctcatttctcttccctcatatttctcaaggcagtgagagaaagcccaacggcactttcaacagtcttcctagaaacctcctcagctagatcatcaaattcattcggtgtgtatctcattttccctattgccacaggtgatagtgttgttaaactttccactcctaaataacaagggtcccccttcctccagctaccaataaaaggttacttacttgccttcaggccttcattgatagcctcctcaaaactctattgtcttcatgaaccctctttttaaagctcttttggcttttgcctggtatctagtctcaaagtcaatgataaccacttaggtttttgttatggaagcacccacattctggtacccaaatctctctcagttactctttttctgtataaaaaatgacctcaaacttagtgacaaaaaacaaccattattttattatacctatggatttatatactgaacagagagtaaaacgaaaggaataaaaccaagtattatcagttggtacagcaaatgtgagatgggtctcattagaatacacagcagtggggaaaagacatattttttgataaattgggaaattcagaaagggtagagtagggacagattgtttctagtctatgacgcctggggcttctgatggaagactcaatgactatggatgactcagtagctgagatctggaatctgaatgtttactcactcacatctggattttgctggccatgtggtgggacctcatacctatatataaacacctagaaacgatcactgaatactgctgattaggctttctcatacacagtgactgagttccaagagtgaaagtcccaagagaagaaagatgaagctgtgtcaccttttctgatctaccttcagaggtcaaatagcaccgcacagttgtcacagaccaaccagtttcaaggagaaaacataaatgtcgcccatctataggatatatgtagcattgtaggaagagcatgagtgatgaaaaatatttttgtggctatctttggaaaatataatcatcgacaatagtatttccaaactaaatgtaccataattttgtcaatcgaatctttaggaagccagcagaaagaggtgatacatataaactatagaatttgagaagagtttactacagattgtttacaatcatttgataggagtacgggaatattatgagagataatgtattatccaggctatagtactgtttccatccttaagtctgaaaagcacacctggttttgaatcataccatatgcattatttcttttccctcttttcaaaaatatgttggcaaaatttgttcatgttcttgcatgtaactcaagtttagtctttcttattattatgtagaattctcttttatgaaaacaccacaatttatttatctactttcctgttgatgaaaattttctttctttccttcattcttttttttttaaagttgtgatcattgtgaacaatgccattctaaacaatcttgatgtatcctagtgctttaggatatataccaggagcaggatgactgaatcatagatcatgagcatcttcagctttactagataatgtcaaaccatcatctagagtaactgaaatcatttacactactacaaatggaaataagaatatatttttatccacatcattgataatatgtagtattgtcagacttttctatttttattattcaggcatagtttggcttaagtttttctgattctgtatttttttaatgtttattggccatttgaatttcctatttatagatgttaacagtacaaaacttctacttaatattctatttagtctcctgtattattatcattttttcagatgtcttcatatattctgggtacaagtttcttgccagttatacatgttgcaaatatctctttatgtcttttttcactttccttaaggtgttaatatttcaccctatggttaatttttcccttctctccttatgcaaaatgacaataatatttaattttttaaatcttgagctaccgctaggtcataatgatattttcttatgtaatcttctgaaagcattataatcttctctttcacatgtaagtctacaaactatctaaagttagtatattgttccataagtggtaagcatctaattttacttatttattgatgaatactcaattgtctgaaagtatctatcaaaaatatatgtattttccccattgctctgtattttaatgagacccgtctcacatttgttgtaacaactgatatacttggtttcattctttctattttactgtatgttcactatgtaagttttccttatttacttttccaattcaattcaattatagtaggttttttttcataatttttctttttatattatgtgagatttgcattctttgaaacaactattactctctatttcctgaaacttaaatacccatctctataaatctatgatttcactattataaaaaagaagataccaacaatcatcttcacttgcattccatattccatattacccttgacatatttccaattgtattaggataagcattttgtattaggataaacattttaatgtattttactatcctaagctttatcttactccctggataaaaagcttagaaacctttaacatttctaccttgtctactactttctgaatacctatatttcttaagataatttggaaattttaatgacaagtgattatcaactttcccttagagtatgcctatattagtttaagagtcattcttcaaattttttctcattcattaccaggctacaattatccatttacacacatccttacatggaagtaaagaatgagagagagattgattcgttgctcaccacctcattttcttctataactcattggtctgttctatttcttgcctcattagaaccctttaaacaatattttttactaaatagatatattctgcaaatctttcaatatctccaaattatttccttttattctgacacataatgttttaattgtgtatgagtctagtgtagcagtccctttgtcatctaaaaatgttattcttcatattctagattctactacttcagacgaagtgtctaacacactccaatgctatttttttaattttgtgactttgttttctatatcataaaacttttaaatttttatcattactcttagagttcacatattttaccagaatatgtgtatgtgcatatctttatttcatcattcttgccagaaacttgatgaggattttaaatttgaagatttaaatgttgagagattttcttctatcatttatttaatcattacctctcttacatcagctgctttttctcttataagtactattgacagcaagttaaatcctttggtttttttttcttccaagtcctttatcttttttttcactcctgccatctccttatattttatgtttggacatattttccccttgatcttccaaaataataatcactgtctcaaagtgtccgcttcttctcttcatctaatttttaaatttgaaaaattaatttttggaaccagaaatatgtgtatgtactataggtgaatttccatacaggctctttgtttaacttcgagttatcagtggtggcctacctcaattgtattttgctacaaatttcccagtctgagcattttacttttcatcttctatttggcttttggctcccttgagtgtgcgatttatagttatttagttactcatggttaaatcttgagctcaaatacagcagaagcaaaataagcatggtcacattatattagtctttatctctggaccaatattacctaaactaccaatttgtcagttgtctactaaggcactagggagaaggccctctgcttcacagtatactaagaagaaaattccaagactccctcacccttctgagtagggaaatcttagctacctgttcaaattcccatgtgttcagctggtgagaaagggaagcaaatatgtattcaccttaatatttgtaaagctcagcaccatcttttctttaatagatcataaatctctacacaataagttttttaaaaaaacctataacactctgacctttaattctgaactgttcactgttgatcactaggctgatttatggcactacatcaacattgtctgttctcagtggtagatatgaagatctttaccaaatattctaggctctgcttgaaagctccagcatttgttgcccaggaaatgtgacagatggttcattagggtacaaatttattagcttagtttcacaaatgccttcaacaacatttacttttcggctaacccagtgagctctgtgtaaaaggagagaaagaggaagaagctctggacacagaggtatgcaacaaaacagaccaacattcagtaaaacaaaaagtaagacaaaaaatccatgtgatctaggggttaaggatttgcataagctcagagtagaaattcttattagagaatacagcagccaagcaagagaatgagttcaacctaatgcatcaccataaaaataaaaattagtgttgtaagtataataataaaagcaagattaaaatgctaaagcattccagaaggaataaattactttcatagagaatataggtggaaaagacttgggaagtcttcctagaaagatggttgtattagtttcctgttgctgttgtaataaattatcagaaacttaatagttttaaaacaacacaaatgtattttcttatagctctggagatgagaaatctgaaatggctttactgggataaaatcatgatgttggcagagctgtcttccttctggagacagtagggaagattctatttatttatcttttacagcatatagaggccatctgtattccttagcttgtggtgccttccttcaccttcaaagtcagcagggcaacatcttcagatatctccctgattcttacagtcttgcctccctcatataagaacactgttattacactgggcctaactggataatatgggaattttttcccttgtcaatatgtttagcttaatcaaatcggcaaagtcccttttctcatgtaagggaacatattcacaggttttgggaattaagagatagatatatttggggaccattattctgcctatgacagtccacactttggcccccaaagcttcacattcatcccacgtacaagttaaaacacacccatgtcaacatcaccataggtctcaacccactacagcatcaactcaaagtctaaaatttcatctaaatgtcagttaaaatgtcccaaatcttatcaactaaatcatctaaatcaggtatgggtgagatcctgggtataatcacctacaagcatatttctctctttttaaaaaatttttaatttttaattattgttgattacatagtaggtgtatatatttataggatacatgagatagtttgatacaggcatacaatgtgtagtactcacatcagggtaaacaaggtatctatcacctcaagcatttatcctttgtgtcataaacaatccaattacactttttcagtttcaaaaatgtaccataggccgggcgcggtggctcacgcctgtaatcccagcactttgggaggccaaggcgggcggatcacgaggtcaggagatcgagaccatcctggctaacacggtaaaaccccgtctctactaaaaattcaaaaaattaaccgagcgtggtagcaggtgcctgtagtcccagctactcgggaggctgaggcaggagaatggcgtgaacccgggaggcaaaactagcagtgagccgagattgcgccactgcactccagcctggggagagagtgagactccaccaaaaaaaaaaaaaaagtatgataaatttttgttgactatagtcagtctcttgtgctatcaactactagaccttattcattctttctaaccatatttttctacccattaaacacccacccatctcccattacccttctcagcgtctggtaaacattgttctactctctagctccgttagctcaattgttttaatttttagctctcacagataagtgcgaacatgcaaagtgtgtctttctgtgcctggcttatttcacttaacatagtgacctcctgttttatccatgatattaaaaatgacaggacctcactcttttttatgcctgaatagtactccattgtgtatatatgccacatcttctttatccatttgtctactgatggacactcaggttgcttctaaatcttggctattgttaataatgctgcaataaagatggagtgcagatagctctttgatatactgatttcctttatttggggtatatacttagcagtggggttgctggatcacatggtaactctatttttggttttttgaggaacactcaaactgttccataggggctgtactaatttacatctccaccaacagtgcataagggttctcttttctccatacctttgccactgtttgttattgcctgtcttttggataaaaacttttttaggccgggcgcggtggctcacgcttataatcccagcactttgggaggccgaggcgggtggatcacgaggtcaggagatcgagaccatcctggctaacacggtgaaaccccgtctctactaaaaatacaaaaaaaatagccgggcatgatggtgggcgcctgtagtcccagctactcgggaggctgaggcaggggaatggcgtgaacccgggaggcggagcttgcagtgagccgagattgcgccactgcactcccgcctgggccacagagcgagactccgtctcaaaaaaaaaaaaaaaacttttttaactggagtgagatgatatttcattgtagtttttatttaaatttctcttaatctattaacctgtgaagcccaaaaaaacaagttttctttccccaaaatagaacagaaaatggtagtaggaaaaaaaaagtcactggccccaagctactttgaaatactactgaacaaatttccttaggatttaaagtgtgggaattatcctctgtggtttgtgttaggttttcaagggaaagcaagggttaaagaaagacacacacacacacacacacacacacacacacacacacacacacagaaagagggcagctcaacagtaaatgcaggctttatgcccagcataaaacctatagaagtggggaaccagcccaatgtcagatcccaccgcggcttacaggctggggcaatttataggtatgggtgggaggggtctggtcagtatagcttgctgcccggcaagatattgataagatgttcccataatgaggcagttctggctcttgttccagcggaatgtcatcgtggtgttccttggacctttgtccagcaagatgtgatagggatgtttctttagttgggactctgactaccttgtggtcaggtggttaggcaggatgtttctcaaggcccgaactcccatgaaacgtttccctctgaccaaggtctgcaaaagagcaggcagcttacaacatggtgcagtttggtctaacagttttcagctctgccatctgagctcccagctctgccccaatgtcatcgtttcctttttcatgaagggtagcatgtgtttgcagcagaagcattttctcagcctgtttcttcttgcagaatttggggaatataacagccttcttgtattttgtcttccttcgttctttttcagttcaagctagcagtgtttctgatgatagaacatttttaaaatccttgggggactctcatgtatgtctcagaaattcactccattagacaagaggctcatcccacagctctttcctatataattccatctctattcctgacttccacttatatggctgaggggctccatgagtcacattcccagtctcttctaagagcctaccatgtgactgaatactctgacttttttatccttccaaacaactggcaaaacgttgatcatcgatctgcacacccttggtattctgtccagagcatgcttccccgcctccctttttttttctttcctttttttttagcatgctttcctgacagagaatctcctaatttcagcatcttttacaatttggataagctgagaactttccaaataataaagttctgattcctttttcctaacagttcttctctcaagctatttcttttctcttttattttactaagcaacaaaaagaaactggttcatatcatcaccactttacctggaaatctatctcggtaaataaccagtttcattacttacaagttatgctttccatgtaactataggacacaattcagcccagctttctgccactatagaataaggttctcttttcctctagttttgagtaacaagttcctcattttcttctggcccctcaccagcagcacttttaatgtcatttttctaccaacaatctgtttatgatgttctcttaagacaatataggttttcactactgtgcttcttacttccttctgagtccataatagcagagtagtcaatatccatatttatacctacagtctatttaaggcagtctaggtttttgctatcatgcccctcaaaattcttccttcttctgcccaatgcccaattccaaaatcacttccacatctttggtatttatatagcaacatcccacttctagatactgaaatctatattagtttcttatcgctgctgtagcaaattatttttaaaaacaacacaaatttgttatcttacagttctgaatattttgaaatcaagtttccaaatatctgggtactgtggtttggcctagttggcatataaaattgaccatcacacataataagagatttcagggattaggaaatgaatatctttgtagagccattattttgtgtaccacagtgatggtctaaaaatgtgaagaaaaaaaggagtaaaataagcagacaaagtgacatgaaggggaatgtgaggtataaacagagttgtagaaaggcatttcaaatagatataatttgcaacagtgtggaggggatagatgggaatgcagatctcagaaaagtggcaagaaacatagctgtagagatggcaaaattatacacataaggggttcatcttcataaaggactttgatttttaccctaaagtgaatccttaggtatggatgatgagaataccaatactgagtcattgatgagtttaagtagggaaagatgagctcatcattgtgtttgagaaagaccattctggtgccagtgaaaagtcctgacttctatggagaaatattgaggataaggaaaagacaaacagggactgaaccaacactgtagcaatgggactgaggggaggagctcaaggcataatctataagacttggtgactgattagttaaagatgataaatcattaaaaatatgcctacaagcatttgaaagattatgttcatgtctaagacagaaatgttattataaggacaattgattgcattattaaagacaatgtaggcatctggcaatgttttgttagagtgatgatatttgattatattctaggaaaatgtcatggttgattggtaggacatgatggtggtttctcactactaaaacgtctcaagggaattttaaagagtctgtagttaaaagacctctctttggagtcccaaggcaagagtagaaagcagcatttaatgaggaccctaagaataaagtggaagctagagaagtctcccaccttataagagagatgaaatgagggggaaactcatggttaagattaaaaatcttaataataacgacaacttatattaagcatattgccaggctccagcaaaaaaaaaaaatgtatacatttatggtttgatcttcatatatacctggtatagtatatatttgccatcagtattgccatactaatgatgaagtgattgaagtttagaaacctgacatcttacccaaagtcacacagtggagaaagacgagttcaaactcagacatctcagactccaaaagctgttctcttaaggaaagagaggcaggttccatctctctttattgacagtcttacttggcataagcgtggacccaatagcagctatggtgtcatatacaagatgcacattacaaagaatggaacaacagacaccgggacatacttgagagtgaagggtgggaagagggtgaggatagaaaaactacctattgggtactatgcttattaactgggtgacaaaataatctgtacaccaaaccaccatggtgcacaatttacatatataacaaacctatacctgtacctctgaagctaaaagttaaaacaaaaacaactgtagagccaagagactcagagttgctactccaaatgcccagtggctagctgtgtgacactgagcaacccttgactctctctgtccaattttcctcatctggaaattagatccatgttttctacccaccaaccaaggaaccagtacagcaaattctttagccttttgtgattattcttttcaccattctcctctgtaggagtgtggggctcagattccccttcttcttttcccacattccgtatcccacctggtagatggtgacactgatgctgacgtatgatttgatttgcaaactatcagacgcaggacctctgaagtcccttcttgatcataaagtctactaatgagctgcagctgataatacttccttttttttttgaaactgtaagtatattcatctgtgaaaaataaattctatactgagatacttctgaagctgcatttcgttctgtactaaggagaaatttcactgaaagaaaaaaataaggctggggagaaattttctctgtgggagaggttaaagaaatactaaagagtcttagcaatggcatgtaaacaacatagaatcattcctgaactctgggacaccttcaaactctgaaattagctatagacagtggattaaaaaaaaagaaatattcctggagtgaaccccgacaaagcaatttgatattcacaaagctctttagtcctgaatcccccccaaaaacatattgtttatttgacttagaaatttaatttaacaacagttgccagttacatggaagtagtgggtggacttttaaaggtaaacagttcagtacagaaactattatgtgtgggaatcgtactctgtgcctactaaaaagcagtatcttcccttagtagaagtgtatgacagggtttggtactgttaaaacaactgaagttcctcataattgggaaattgcctcttttgcacagtccatcagacactcacttggctgcacttaatggaagatgctgatggaaagccacaaaagtgtcactggggtgacattccatttaaagtcaccccaaccagacattgtgagctttccagggggaggcataagcgccaggctggaagcaggcgggatgataacacaaaacaactcaggagagagctctacagcccagtgactgagggatgaggctctgtgggtgagtagaatctttgctacttgtagatggattttgtttctctctcacaagacctttctaagtcctgcctgctccctggagaaagagctcagaatgtgaaaacaatgcatagttttatttgactgagaatttatgtaagcaaaaataaggagtagaaagaaaaacaaaagccctgtataatggcatgaaaactacattagaaaacaggaaaacaactgtatttgtgacctctgacaattttagcctctattttgtcatcagcgaatgaagggccttagatgatgtcaaagttagcttttaaggtttatttctgtgaattaataattgtttattttagttgaagagaagaatttaagaaaaaaaaaagaaaaaatgtaaataaattagtaggtctttctaagaagtaaaagggaagattggcctaagttgattatgatgattgttgataacaggacattctacctactgactgacccctttaaaaataaataaatttaaggggtacaagtgcagttttgtttcacagatatattgtgtagtggtgaagtctagacttcgagtgtagccatcacctgaataatgtacattatacccattaagtaatttctcatcctttagcctcctcctaccttcccacccttcccagtccaaagtctattatttcacacactatgcccttgtatacacattatttagctcccacttgaatttgtttccctatctccattctgttatctgttcatcacctatacattgtctcaaccattaaaaaacttccccgtggattgccctgcctctattcttatcacttgccagtttgtttccattctgcagccagagacatattttccaaaataccattctgttcatgttactcccttgcttacaaatcataaatagttcactgttggcctcaaaacaaaattcaaactccctagcatgctgcataatgcattttgtgatatggccctaacgtagtgccactcacagctgcaggactagagaacaagcctccaaggactgaggtggtctcagaaagtcttcttgggacagagaacaggagtcatgtattaaaagaggtgcacagaaactagcaggaatgcataatatcaaattttaagggttgagaacaaaagcctgaggcccagaagtaaattcaaaaagtctgaagcagaacaaacagaaatggtgcaaagactgggtaaaggagacactttggagaaagataaaggtggagctcttcataaacttgctgccctagtgtcttctaggggacaggagtgatgacgtaaaggagccaggaggactggagactgcacccctttccagcatcaactcttgccacttgccttcacctatgctgtcctctagccatgctcaactcctctgtggtcactgaaaaatacgccaggctctttcatatgactttacccatgccttcccactctggaatatacctttttcttctgcctaataaactcttattcaatctttaagacttgccatagatttcaaacactgactaggcccttccagaggccctgaaatagttcattgttccttccctgtctccacagaaacttgtacatacctaaagggtatcaaatagtatatacaattattgtttgttaatgtggccatatccacaccagattgtgagtttctggaggataaagacatgccttattcaatacattaagcgtaggagaaagagattgacagactaagatccgttaaagacatacatctttctcataaatgaacttgaggaattaaaatagagctctatattaagtagtattatttttctgacttcaagtgacctcgggggatattttattctgattaaaaatagctgtaccaaaaatattctttctgcctacccataagagggacacctgtaagggcaaatatccaaaatctacaaagaaacagatttacaagaaaaaaacaaccccatcaaaaagtgagcaaaggatatgaacagatacttctcaaaataagacatttatgcagcaaacaaacatatgaaaaaaggctcatcatcactggtcattagagaaacgcaaatcaaaaccacaatgagatgccatctcacatcagttagaatggcaatcattaaaaagtcaggaaacaacagatgctggagaggatgtggagaaataggaacacttttacgctgttggtgggagtgtaaattagttcaaccattgtggaagacagtgtggtgattcctcaaggatctagaactagaaataccatttgacccagcaatcccattactgggtatatacccaaaggattataagtcattctgctataaagatgcatgcacaagtgtgtttatcgcggcactgttcacaacagcaaagacttggaaccaacccaaatgcccaccaatgatagactggataaagaaaatgtggcacatatacaccatggaatactatgcgccatacaaaagaatgagttcatgtcctttgcagggacacggatgaagctggaaaccatcattctcagcaaactaacacaagaatagaaaaccaatcaccacatgttctcgctcataagtgagagttgaacgatgagaacacatggacacaaggaggggaaaactggggcctgtcgggggctgggggaataggggagggacattaggagaaatacttaatgtagatgatgagttgatgggtgcagcaaaccaccatggcatgtatatacctatgtaacaaacctgcatgttctgcacatgtatcccagaacttatatatatatatataaaagaaccgaggatcaaaatactagacatgtgggctaaacagtaacttgctttaggcatcacatagagtttaaaagttggttttcggctgcttcccagagcaagatgacataagctgcctagtctgtcttcctgtgaattttccattggtggggtaggggggtataaacagtaaagagagctggagttggatctggcactgcttacatcacaccaacactttcctttggatgagaagctacatatctagaaagctggatttggggagagaaagcatttggaaagacatgaatatcaaaattcctaaagttgataggtttttcattgctctattgtctttctgggatgagaaaaacactttgctgtaaaaaaaagaattcaatttaagtaaattcaattctgcaaatgtatattaggtttctgctgggataaaaggtcctatgctaagttgaggaaaatctcaacttgaacacaaaaagacaatcaaaagacatagagatgaatctgatgttgaaattatttaacacagatattaaagcacatataacaaaaataagaacattacaaatagtcctataacaattaaaaatagaaatattaccaaagaaatgatattaaaaaaacattttaaaactggaagaaacaaaaaccaaaaaaaagtgttcaccactcttatttaacatattaatagtattagaaattctacccagcataatatgttaagagaaatgaataaatagcatataaattgaaaaagaacaagtagtactatccttattcacagaagacatgattgtctacatagcaaatcccaagcaatctaccaaaaaaatattaaaaataatgagcgagttcaccaaggttgcaggatacaaaatcaacacacaaaagttaattgcatttctacatactagcaaaattaaaaacaaaatggcatttacaaatgttccaaagaaaacaaagtacttgggtataaatataaaaaccttgtataatatctatatgataaaaattataaaatactaataaaataaataaaagatgacctaaactaatgaagagacatactgcatttatgcatcgaaagaccgaaaacagtaaagatatgaattctccccaaattgatctataggtttaacaaactttctattaaaatcccactaagaacttttgtgaatatagacaaaattattataaaacatatacagaaattaaaggacctagaatagctaaaacaattttgaaaaagaagaataaagtgataggaatccccctacctaatgttaaaacttattacacaactacagcaatgaagacaatgtagttttggcagagggataggcacgtaattcaatagaacacaacaaagagctcagaaagagccccacacaaatatcatcaactgatttttgacaaaggtccaagagctaatttgatggagcaattatagtcttcaaaataatcgtgccagattaattagacatacagattggggggaaaaatacacgtcaatttaaataagaaagaaaagaagaaaacatatgcaaaaatcttcaggacctaaaacgatataaagagttcctattcttaacacaaaaccatgctccataaaatgtaaaactgatctctttttttttttaagtaaaaactttttctccacagaagaccctgtgaaggagataaaaagacagtaagatccaggctgagagaagacacttagaaaccatatatccaacaaaggaatagtatctagaatacgtaaagaactctcaaaacacaacagtaaaaaattacagaattcaactagaaaatgagcaatagacatgaatagatggtaataagcatataaaaagatgttcagtatctttagccattaaaagaagacaaattaaaactgcagtgagaaaccaccagacatctatcagaatgactaaaatgaaaacttgtgataacaagaaattctgatgatgcagaaaaactggatcattcgtacaatgctggtgggaatataaactggtacgaccagtctggaagaataaggcagtttcttataaaactaggtgaaaggtacatgagatttcttcgacattttttttttcaatctcctatacattactacaaagcaaaaaaatttaaaatacatatttactgttatcttctgtgtgatcatatttaaacattcttaattgacttcctattatggaaaatgaggattttaacttttttttattctccctttcccttcatccctctcttcccccattatagttattatgacaagtattggttaaatctgtgtttagtatttgtataattatggtattataaatattattcactgatgaaacaggtagcctattatcactacatttattttcttgaataaattcctacttacactggtgttaaaacctcctctttgtcccattcgtttagagtaaatatatagctacgccttggccctacttttttgacaactatacacaattttatacacagaacacctgccaattccatttccccctcagagactttgctgagatttcctgtcctgtactttgctctggatgctggtctacataagttgtgctgcatggtggaagacctggaagttctgtcatcattctgggaattctcctcacttggttcctgtgtttggttccctgcttcctcaatttgatgttgtcctgtcttggtttactccctttttttttttttttttttggtggtgcacatatctagcagcttcctgagaagacctacaagcagacaaatattttatatggctgaaactattttaaatttaccttatacctgattgattagtgagctgggctatgattctacactgaaaaaaaaatttcgtctcaaaatttagattagtacataataaaaaattaatgcatttatctacaattttttattcttaacataaagaatcttaaattttatacatcttaatctttatatatactgttttttactacctagatcaatttaaaatgaacctttatcattgtaaatttatgattatttctttgggtgaattctcagtgggccttttccaccaggaaactcctaagaatttttcttttatcatttctttgacaatttccttccttccatttcctgctccttttgttcccaaaatcctttggctaaacaacaccttctaaagtaatgccctaaattttattttattttatttgtttgtttgttttgagacattgtctcgctctgtcacccaagctggagtgcaggggtgctatctcagctcaatgcaagctccgcctccccggttcacgccattctcctgcctcagcctcccaagtagctgggactacaggcacctgccaccatgcctggctaattttttgtattttttagtagaggccgggtttcaccgtgtcagccaggatggtcttgatctcctcacctcatgatctgccctcctcggcctcccaaagtgctgggattacaggcgtgagccaacgcacctggcctatttcttccatttttatctctgccttttttgctgtactttgtggatgatttcattgactttatattctaaacattttacatttttaaaaattttgaataccatattttattttctgataattttcttgctttctgattgttttttaaagcacttggattacatctcaccaatacaatatcttcccttatctctgtggctattaattataatttctttcatattttcttctacttattgggttgtccgtaatttttctaagttcctctttcgtttctgtttgctttatttctgtctttcattttaggtatgtcccacaatattcagtgattgtttcttattcatatttaaaagtgagaccctaaagagcttattgaaagttctgtgcatatattcagggcttcttaattggtatatatcactctaaactgaccaggaagtattttagactttttttacacttctccaaatttcagtatatgtaggccccttctctgaatcagttgtgtttctttcacttttcctccagaggagaatcctttaaacttctatcaggggatataagcccagctactgacattttgaagctagttgaacaaatggatctgagatgggaaatcttaccttcaatatagactttaatctaatccccctgacatgctttggatgtttgtcccctccaaatctcacgttgaaatattaccttcaatgttgggggtgagacctagtggtaaatattgtataatgggggtggatccctcatgaacagcttagcaccatccccttggtgatgagttcttgcccagctcacactcaacctgtttaatagagtgtggcacatcctccctctctttcttgctcctactctcaccatgtgatatacctgcctcctgcttcaccttccaccatgattgtaagcttcctgaggccctcaccaaaagctgaacagatactggcaccatgcttcctgtacaatctgaagaaccatgagccaaataaacctcttttctttataaattactcagccacaagtatttctttataggaatgcaaaacgtgaccaatacatactgttttaagtacggagctttactgttctgttgagtctccccaaatccatagcctctctcagtctctcaagaaaatatatctccagtttttttcactcatgaaggagtggactaagtcctcctatgaagactttaaaatagtccttcaattgtcagcccagccagaaatctcaagaacttttttttaacttggaaaagaaaaagaagaatgcaattattaactcagttcccattatgtctctgacactatgttgccaccatatttacattatcttatttaatcttccataccttataagatatatcattcctattttacagaagatgaagctgaagctcaagtggctaattaagtttctcaacatcacacaactagtaagagttcaacataatttattaataataaatttgatataatgtattgttggagttctttactattttatcgaagtttgtgtgaaagttccaaggtaggcaccagagtattaggaacgtccttgtatatcagccgatacggatggcttcttagatgttcatggacctaacgtacatgatcctgccttgctgattccctagggcacaggcatcttttctaagttgggtaatggcaatggctaccatatggatagcatacagctatccttagctgctccacacaggcatatgctctatggtgctgaaaacactctggagggtgaatcataatgggacatgagaacttgctgttttcagaacccatcaacctttatctgtttcccaggctaaggaaatctctcaaaagtatttatatcactgtcatctctacctttcagggacatgaatagcataatctccataagttttaagtcttttacagaaaaataaagaagagtgatagatctaagaagcttctgtttctcactctagagaaaataatgaggcaatgaattagcctgatgaaatattttttggaatgggagatggaaaaataaaggtaaacaaaacaatttaatatctgatcaattattctgacatatacatactacttttaaaaatctggccatttcagcaaactctctgtatgacaccactggtttttaaaatcatgtctttctgttgttggttgaggccacttgcaatatacaatgtgaattgcttttttttttttttttttttttagaactttcctatttctctagtagacttcccttccagatgtcttatgatgctgtgtcattatcgttttttctccgaatttcttgaaatctgattcttaaagcaaacttcaggctatgcttactgtttcctgctctcactattacaaactagcaacatatggcagctttctactcacaggcaagtctctttcacttcactatatgtttaggcctcaagtgtcagttccccctaggtactttctctttctcaggaacaaaatcatcaaaaagtcaagaatctgttactcttttagctgaaggagtgttttttgcagatgctgtgggattggctttgtgtgcttctttggttggtgtatggcagatgcacctgatggcagtaacagcataccctgagaatgcccctatggtctaagaagaatgtgtgttcagagttttgagctaaggaatctgggagtggccaacctggagatttatgccttatgtatgaggaacatatgaaccctcagtccatcccatggaatacaggtcatacagaggatcgaggccctttgtatgggcttaaatgaagattgccaggtggaggttgtgctaaggggagggtgctaagtgaaaatactatataaacttcatattttttacaagtggttgcagttctcctgtctagcctgctactattggaccaccttgcatgtgagtcccctcagtaaatcctaagtcttattcactggctctagttctcttctttggcctcttatacatgatgctatccctactgaaggaaatatgggtcgagcatgacagttgggacatgttgctcatttctgttatgggtatctgctgcttgtatgtacagctactatgatgtcacctctgttcctctcctgctatcaccatgaaaatggactctaaaatctaatgtaaagatttccacagtatacacactttgatatacagtagaaccctgcccccctgtaaggtacatggatgtgctttggtcaaggataggccggggtgcatatccaggcctacatgactcagcaagtttgaggcacaggcgcacacctccatctgttacatcacctgtttttgtaagttcatacttggctctgagccactattacctataaaaggtataattgctctgctaaagctgtacaggggctcttggggctcggcttggttcaacatggatcttgtgctggtgcccagagagagggccaaagctgtcccgtcttgcagatgcacagaggggagccacagcactgctcacgctggtgcccagatatagagttaagctactcaccgtgaaggcaagggggagccagtggtgcagctgcaggcttgagggcagaaggagccatagagccagagcagacagccaagataaaggtgcatactgtaacgtagtgtaagtaagttgtcaatgacagctgctgctgaataaaaccgtattcacctgcctacagccccctaagtgctctttctacccatccacccactcccctcagactgcagcatgggctggacctggaccccacgatctgacaattgacaaatatggatgggaagaggtgggcagatcttcagtccctgagggctccctggttggctatgaggctgcagcatgagctgtggtacctggtggcagcggtgctgcatggatgggaaacataaatgatagtggatgggtctcctgggagtgtggagaaggcgctgcatcacctggaagtgcaagcattgacaagaggcatgcctttacaagcagagtcagatggccatttgtgactgtgctgtagggcgtgcatgcccagtccttgcaggacgcagcacagggagaaggaagaacctccattgcaggctcacccagtgatccacctgaaaatagagcatgagcagctgtcaggccccaagggtgggccagagaccccactactgtggtgaaacacattacctttgttgcctgtgtccccgctaagttgtgggagttaagcaagtaatgtcggcagtcacgtacagacttagtgcaggtcatttgggagaaggatattgcttcacgacccagtcctgccctagcattccacttcaaagagtacctgctgccattagcgggagtgtaaagccttttctgtttgataagagaactggtcgagatgcgcggcttgtaggggggcaccggacaaccagagctacctttggacttggcaatctactggtccctgaacctggataaatttccaggcagagctgcatttattaatggctgtgaagaccagtcagtgaaaatgaaaacctgtgtctttgcatcttggcatgggccgctttgctctctgtgtatgcactgtgtctctcccatacctgatgcattctggggctgaatgttttgcatggtttggtaactgtgatgtctgttatgggcttgatggaccatttgacaacagaatagggacagtccactgagagccaggaacagtttgccttcatgggaaggcaacaatgaactttcacagtgttgctgcagggctattgtatggccccaacatatgttgtgattttgttaataatgtaatgttaacctctgattctcttgcaggttgaaaagtggcagtgccctttcttgtctggaattaggatgatgaggctaagacagcctttctgtgtagtaaatcaagggtgcccatttacactagatgtacatctaaccacagatagttttggctggggcctatagcagtgcatggagtgattggaagtgccagtgggctgttagtctcagctgtggaagggagttgagctctggtgttaatagagaagcagttagtaatagcaggatgggtgtgttcctgggtaaccagcccccagactgggaaagcagctagtgactgcatatgctgcccttcaggcccataagagcatggcaggatgggttacagtcatcatgcaggcaacttgccctgtagctggatgggtgcattcgtggataatgagcccctggacaaggatggtgcagacatccattttaatgaagtagggtgcctacttagagcagcggagtatgctgagtacgactcccttagcagcagagttacaagaggttttagggcttgtagtcctaatacaagataaggccatggggcgtgaggcacccctagaccctgagccttcaccattaggaagggcatccccccattcctaatagggcatggtacacagctgggtctagctggggtgctactgctgcctggagtgctggtgcagcccagcctagtactgacaccacgtggtttaaaaccaggtgtaggcaaagttgccaataagctaaactcagggcaatgtggatggtaatcaccaaggaagtgacacctactgtaatctgcgccaatagctgggcagtttatcaaagcttgtatatgtaatgggcctgcatgcccagaagcttatgtatgtatcaggcctgtgtgcccaaagcttatgtgtcaggcttatgtgtcaagcctatacgtatgtactgggcctgtgtgtgcaaagcttatatgcataacctgtgtgtccaaaaccaatgtctctctcggcctagggggtggagtgtaaggtacatagatgtgctttggtcaaggataggccaaggcagatatccaggccttcatgactcagatagtttggcgcacaggtgcacacctctctttgttatataacctgtttgtataagttcatacttggctctgaaccactattgtctgtaaaaggtataattgcactgctaacactgtacaggggctcttggggctcagattggctcagcatggctcttgtgcaagctctggtgtccagagaaagagagagagccaaagctgtccatcttgcagacaaaggagagccacagcatggcccgcactggtgcccagggagggaaagagttaagcggctgaccctgaaggcaagggacagccagccacacagctgcaggcatggggacagcaggagccacagagccggagtagatggccaagataaaggtgcacagtgtaaagagctagtgtaagtaagttgttgatgagagcggctgctgaataaaaccatattcacctgcctacaccctcccgctgccaccccacccccagccccccacgtgttctttctgcccatccactcactcccctcggaccacagcatgggctggacctggaccctgggatctgacactcccacactacaaaaatgtactgtttttggaaagagcttacccttaagccacgattttccaagtttgagcttcaacccagaaagtctcagtaattttaatatatttgtattgattgcctgatgtgctaatctcaacttcacatatgaatatgaacatataccccttctggtcttctttattattttctttttttagagttataaaatacttggtgtttttctgtctttactctgtatcttaaagcattttctctcaccttctccatagttcagtgctgttaattgacaaaaaagctatctagtaggccatatattctcaaaactcaatgcataaggagcacctgtaaagctaatttacagaagctaactcagtgtcttccaacccctttttcctgctgagctcagtaagttggtgataaggcccaagaattggtattctgcagaccacatattgagaagagctattccagacaagcaagtgtcccccacttcagtgagatgagctacattatccaagtttcatcattccaatatcttaggccattgtccagaaattcagatgattgccaataccatctgtggagccaaatgttcaactccacgatcatttttctcttttaaagtcttctggataggaggaaatgttgaacataccacctgggatctgtagtgtccttacttccttcaactttctacccaaacctcagaaagcattatattttcaaatgccaccaagtcagaaagagcaagaaatggttagctcttttgccaaaacttatccttcccctatacaatacatgctttggaaaaataggacatctcctgaaggataaagatgtttacattcatttgcatctaaatgaatcagtagaaagttactaatcactgataacgggtacctgcctcctaccttcaaaggcaagacttactttacctaaaattatttgaaaattattcttactggagcatgtgtttcccaagatctaatttatctcaatcagtggttctaaaccaagtgcaattttgacaccaggggacatttggcaaagtttggagacatttatgtttgtcatgagtgaagaatgggggagctactgacatctcgtgagtagagaccaaggacgttgcagtacatagtacaatgtacaagacaccaccccaccccactaaaaaacaggaaataaatgtaaatagtgcccggattgagaaaccctgctgtatatgaaacaagcatcatacctaccatgaatacacagtaactaccatatgctaactatttgtattcttattaaatatatgcatcatgttagatcagtgtcataacttttcaaaattcattctgatccctcagcttttggctttcttatgtaactttctattccatatattactttctttttcttattttttctgtattagaggcattatcgtgaacatctgtgtttttgtatctccagcaactctttatcggaacagcatctcagctgctgcatgtgattactataagccaggcaatcatgaactcccaaaaaccctaaacacatgggtgatagcagggcccaatgctaagcggatcttttcctgctgggaatgacacacttaagtgaagacacacaagagtacaagatctttgtaactaagtcatccagtggtactactctaaagagaacggttacacatttctgctgctgcaagctgtactgagttatcttttaattactcagaatattttcactttttgtttgttcatcatcattaaagactgatacatgttgctagtagccaaagaacaagagataataaacgtttcttttttttttttttttttctcgcactgtcgcccaggcaggagtgcagtggtgcaatctcagctcactgcaacctcagcctcctcagttcaagcacttctcctgcctcagcctcccgagtagctgggattacaggcgaccaccaccatgcccagctaatttttgtattttggtagagatggggtttcaccatgttgtccaggctggccttgaactccttacctcaagcaatccacccacctcggtttcccaaagtgctggtattacaggcgtgagccaccgcgctccgcgggataaatatttctttattgttgatctgctgacacagcgaagagagattctcccagctgcttcacttcttccttttgaaagaaactagcctgaatgtgttcacagttatttgggacttacctctggtgaggaaagcagtatacatcccttgaagttctgaagccctcgcctgagcccactcaataaacagaatattttacaacagtgttacttaaaaggtggcctgccttccaggagtacctgcagcttattagaaatgcagattatggaactcacatgactgcaggtctcaaatttcagcctgcataaaaatcacctggaaggcttgttaaatgaagaggcctagcttgcccccgcagagattcagcaggtctcagatggggcccaagaattttcttttctatccagttccaaggcagtactgctattgctgttgttcttcagaccacatttagaacagctctgtgagaacatgtcactttttctcctttttaatctttatcttatctgacataaagcacagttgcttcagttgcaaataaaagaaacccacctcaaactgacttaaatagcaaagggaacttatgtcctgatacaaattgcaatttagaggtttgagggtttcagctgtagcccaattacatcgccaactgcctggctccttccaagtaatattctttttgaatattgctgaaaactgtgaagctgtcagatctgatggggatgtgtttactaatgtggccactactcaaatttatctttaaccatatccatatagcatttttagcatattgtaggccttcaatgaataataaatacagatctctgtcattccttcttctttgaacaagctgttgtctacctggaaaataattttttatctactcatatatccgttccttatatcacaataactcccaaatgtcaagaacccttatgtgctaggtagagaatggagaacaaaacagccatagtactactttaaaaagcttcaataactttctaagaagctttcctaacttcctacccttattcccattccctaaaccaacttaggaatacttgctagtgccatccttcctcttacactatgtaccccatgatattgtatatataaagtaaatagaaaaacataaataagtgtaaagtgtaatagatacaataaagtagaaagagatgactgggggaatgtgacaatgtggatataaaggccatggggattttgtaacttagatcaggatcctctcaagtgatcttattacgatactctcattttgaagtgtgaaacacacagggtaataaacattgggaaagcataaaaaatcccacaaaagaaattacattatgttttattaaatcagagtttaaaaatatctgattatgtcttgaaaaatcaataacgttgtattcttttttaataatactcttctgtcttgggatagttaactgtatttactgttatttttccacataagcagaaaaaataaagccatgagggagtgtattggagatgtctgcagttgagtcaatcctgtagagtacagagttgatttataactccatttgatccatttgctttagtgatggtcttttctcttccaatccagcatggtaaagatctgtcagagaaaacaaatgactcagactccatgtgctgtgtctgtgtacagtttatccgtcgtccttcatgttcttcccttatgcacatctgacaatgtctctcaaggttagtgaaagagtgagcatacctgctaagcaaattggaaataaaatcagaaatgttttttggagaaaatgcagcaaagaagccatctcctccctcctgccccaatttatcatgtctttaagattttctttttggtcttcttcatctctcaactcatgaactttggcattgacatagccaagatgatttttttctttctttctttcttttttatttttattcttttttttttttttttttttttttttggttggagaaggggttatgctttgctgcccaggctagagtgcagtggtgtgatcagagctcacaccactcacactactggggagtagtcctagctggtccagaggctgaggctcaaatgatcctcccacctcagttgctggagtagccaggactacagggatgtacaccaggtccagctaactggttttttatgttttgtagagatgagatctggctatgttacccaggctgaacttcaatgcctggcctgaagtgatcttctcaccttaggctcccaaagtgctgggattacatgttagagccaccatgctcagcccaagatgactttttatggttgaattttcatgtttctataaacaataatgatggtgatggtgatctgatggctttgtcaaaggtcaagaaagttccaggactgttgagttagaaatagcgtgtcacgttgtttgggtcattcacagctgacagatgggcaaaccacaagcaaaggaaatgaaaaagacatctgctgggcaattctgtaaaagacaggatcaattttttgtgggataaaggattcttacaattttggacaccgcactaagaaaaaaggaatgcaaagtaacaaataaattgtatgaaaagtgtttagaaaatgaagaaaagaaatgggaaaaatttacaaatataaaagtgctgatggataccacaaacatcacaaaattcagaaaaataacaatattcgtattaatagctactatcttcttttccattacgtactcccaattgtagatgctatagggcacttttatatatagcagaataactctggccctgcaggttcacattatgatactaagtaaacttcatggcgagcagttaggaatagaactgacagtcattgccatacttaacaattacttagctatttacaaaaagactgcaaagcacataaactctcactaaacccaaataaaatgtactcccatttcaatttccccttttctatatcctaaagttgccacaggctactctaatgcccctttataggaggcagagtatgccaaggggttgcagtggaaaggggcaacagacggaaatgatgtggtttaaatgtattacaattgtatattttacaaaggcatagaagcaagttgatgatgattctggaagaggacctggaaggagccccagaaggtgatgagccctgaggcttaagattcatcagctttatagtaaatccaaccaatgtactaggtgtacgtattgaggaacttgactataaaaattcagtaaatgttttgagaacctgtactagacaaattggggggatttatgatgcacatggtatggaggaagggaacctatttatttatattttcatcttaggatttttatctatgtgaatatattacctgttcaaaaaaataagtaaatatttttaaatagaaattttaaaagaaaccagtgagacatggttcctattcccagctttgataagctttctcaaattatgcaggggtgaaagaagaaaaaataactgagaggttcaagaaccctcaggaatgaaccaagatatataagaatacctatgagaatatctatatctatgagaatatctatgagactattggagcttcaattcagacttaattctgagcaggaagggaagaagaatgaaaccacatagagtagaagggtatgcaggcggagccattgtgacattagaagtctggtgcagtcacaaaagttcatttataaactctcgtgcagaatgagggtcaagccatctcagatgttaagtaggaattcagaaactggaaggccaggcaaggcacaattgaatgggctggaccaaactgaccagaggaggaagtctgcctttaagcaaactctcacatgcccctgtttaccacacagtcactaaacaagccaagtggtccattacttgtcttgtctaggaggtagcctcacaccatagatgtgtgcaaagcttcctcccttagccctttatgagcccctgacctacacttatgtgaacataataaaataattgtcattttaagccactacagttgggcaatttgttacacggaactgtagccagaatactattcttcgtccatttatttttgaagcaagatactaagaatgttgagtataaattattttgaatcaagttagaacatttttgttcaaaggtctggaggaattccctcagtgtgttatgacatgttgttagatgagtagatagataagtaacacaaccctcagagagtagcagttgctgtaacctccaagaagcagagtgtgtgccagtcctcctgtacaactgcattcgaatcatgctgagctcccaaggcctctgcagccttgctgtgcccttttacctctaacctatgtgtgtgctatcccttttgccaggaagtgcgctttctcctttctcctacagcttctcgcgtgctatttcctttctactacctttcattccttcgatcacttccgtcctctcatcaccaccttcttctttatctaaatctacttggcaccacttcctctagcaaacattctgtatccaactccatacagggtaagtgagcttagcttctctaattttacagccccctgcttttctctttgtgagcaatcaccacctgcaggttaactgcctatctgcataactctttcacaaaattgtaaaatccctgaggatagggaaaaaggctattttattgtggtaccaccaatgctctaacatgcacctagaatttagctcatagtgtgtgctcaatatttatggaccaaaaggataaatgaagtataacgtgtcctttaatactgcaaggattcacttcagtgaccttttaccccagtttttgttagtatgcattatggactaaatatttgtgtgtccctctccccgtcaccccactacaaattcacatgttgaaatcctaaccttcaatgcaatggtgttgaaaggtatggcttttgagagataattagattatgaggggaaacctccttaaatggggttagcacccttataaaaaaaagactccagagagttctcttgctctctttctaccattggaatatacaataagaagtcagcagtctgcaaacaggaagagggtcctctccagaacctgatcatgctggcactctgttgttggatttccagcctccagagctgtgaaaaataaatttttattgtttaaacaatatagttggtagcatcttattataacaccccaagctaagacagtgtatattggccaaatgggactgaaccttttttccattctcagagaagaggaggaaccattctgtgaaccaataccaagacgtgggccagtgaaagccattggataatctctatattgacctggttcctaatattctatgaccaactatgatgggccagtaataaagtgatacccccaattctgttggaagtagtataacttcagaaggaactgcccacactctctttcaggcttttcaattaagcctgggccagtgtgggccatgccctgcccatctccacaatttagaccttcaggtggctgtggtaaaggagaaggtctggcctacaaaagcatggtcatgctgaccctgactgaggctaggcaaggctgctcagaagcatgggaaggatgcaatccttagtcaaattacctggcccaatttttgctctgcaacatatttcccatgaacgggtaaagctgtactcattgattgctatggtctgaatatttgtgtcctctccaaattcacaggttgaaacttagtcgccaatgtaatggtgttgggaggtgggacattttggaggtgattaagtcataagggtagagccctagggaatgggattttttcccttataaaagaggcccaattgagctctttcacttcttccatcatctgaggtcaccactaaaaggcatcatctatgaaccaggaaatgggtccttaccaggcaccaactctgctgctaccttgatcgtgaacttcctagcttctagaacgatgagaaatcaatttccgttgcttctaaggtacccagtttattatattttgttatagcctgaaaacagaggaaaaaaattgataaaatgaagaaaatggtaatagccacatcactagaatgttcttgagataaattagctgataaatgggtaaaatgtaaagacttaacgaggtatggataagacatggtaaaaacatcagtaaaggatgaaggacatcatctctattaatacagcaaataagtggctcagccatttacccatgtccttgagcaagtcactttatcatctttgcacctttctgctcaaatgcaaaattgaagtaaaagttgtatctacctacatatgttaataaatgtaaaatgcttaacccagaacctagcatgcactaaattctccttaaagattaatgaaacactagtatgtattcttaaacgccctttgaaagtttaggaaggttttgtttgtttgtaagaattaaaggaggcttcatgatgaaggaggtatgttgtctgtgttttgttttgttttaatttattttatttatttatttatttattgtttgagacagcctcactctgttgtccaggctgcagtccagtggtgcgatatcggctcactgcaacttccgcctcccgggttcaagtgattctcctgcctcagcctcccaagtagttgggattacaggagtgcaccaccacgcgcagctaatttttgtatttttagtagagacgggtttcaccatgttggccatgctggtcttaaactcatggcttcaagttatccatccgacttggcctcccaaagtgttaggattacaggcgtgagccaccatgcctggcctgttgtctttgttttaaaaagtaggtagcatttggacatagaaagacaaggagaaaaatctagggaattttttctaacctagagaattaaacaggtacattttgccggccggcactatggcatatggtaggcaagaagcagtaggggtggaaagaagagagaggtaatctggagacttctagtcagtccaacccttggcatttcacagactggaacccatagagtcaatatagaaactgaaccagaccctttattctggaggaatttccagtagataattaaaattcagtttttactgcttggtctagtctgttaaaaaaaaaaaaaaaaggaaaaagtcaattttaaaattgttcatcaaattatctgctctgttttttacaattagaaagatacttacctttcctaagtcaaggtcttacacacagacacacacacacacacacacacacacacacaattttacctagtaattaatacagaaatcctatcccacctttttgacttttctactccacccacatcccctaacccaggacaatttcagccactacaaacaaaaaaactagctgatagaagtgtaacccaaacaaattattaacaacaacagcaacaacaataacataaatgtttattgcatatcccaataggcttaaccagcattaaaatgataaagaaaacctcattctgtctcattgtcaactgttctactctaaaaaaatctgttaaaggtaagaaatattttttagaaagtcaataaacaaaaagaaaaaaaaaaagtcccctggagagtattagagtgtttaccactgggagagagctgccctctgaagaataaagccaaattactggcttttctgagcctcactgatggggggagagaggaagaattaagacagctgttcttgtcttagttggagaagctgcgaagaggaaactgtgggtggtatgtctgctgagtaagacttctcagaaaagtggttcctccagttttcaggttcctggaggcccatgacaggctacttcctagcactcattctgaagactttggggtcaagagcagccctggccccctatccctactacctactgctatctcatatttcctgtgctttggggcttttcacctaataaataactgtcctttgagtaaaaacacaccctcccaaatgccaaatatattttagtaatgaactagtgcaggaatggccctttgaaacttagaacaggcctcactgaaaaatagtacattcttgtgactttaacctagggtcttctatgctagttcagcttaaatcctctgttatctcattatggaaaactcacttttgtagggttcctctaattttctgcaaaagcttcaaatatttgttgttttaagtcctccttgtccatagagtctgactatgaaaatggaaagaatcttatttttaaggtagtctagccccttagactagtccagatttgacttctccaagcaacataattcagagagctcttcaaataaatgatgctatgatcctatctgggcatcaccccaggaggcaagtgtcagaggtgcctcagacttctggacccaggctctttgcacttactgcaaagccttactgtctccagaacacttcctttctgttttccctctccatcttgtattaggattctcttatctgtaccgacatcccatctccttcatgtctatcaaatcttgctagcaggaaggctgagatcaatcacatatggctcagtttgaatttgaatccctacactcactgtaacgaaggagaagatttgctcttgacttggagaattttagattcttcttatttatatgaccaagaagagaagtttaagggaagcctcaaaattataccacaaaaacatttgctcacttagcccaaacataaggcagatattgaatatggtgaaacatgggctggaaagagttgcaaaattcactcccccctatgccctgggtccctcctcagcagggacagccaagttgtttccggctgacagcaaaccagtcctgatatcctgttctcatgacacactcaggcccttcactgtttctgttcattcctgactatctttataccagttggaaatcctgctgccgcagaaactaaaaatgactcaaaagtactccctctctttcttccaaaattgtgtttctgcacagcctgttctgtgaccatcacatgactccacatttgctcatctgttcttatctgccatcaagtcctgcaggtctttctctggaatcctgtccccaactcattgctctttctcgtctctccacagcctggttctgagacagagggcagcaatttctcatcccaaatgcctcgtctgggcttgcagaagttagtccaaagacagattgtgaaatcttcattgtcagttcttggccttcccatcccctttgagactcttcttccagtgggaaaattacgcaggcacgatatgtacgcatacaagtattcttttatgtgagttttggtgttactaatttagccacacagtatgacctaagcagcataggaattaagccttaaatatttcctaatcatctgtaaaatatttttctccattcccaatatattgtcttagttcaggccttcatcatctttttttttttttttacctgaaactggtttcctgaggagtctccgtgcttctcacctgcctctaacctcttctttccccatatgtcacactactaccgctgtaatctaccaaaaatgcaagtatgactgttagtgaatcccctgattaaatgtcttagcatctgtaggacagaatttaagatgcctagcatgatattcccgatttcctcgggagttgtctcctgctctaccccaagctgcgcttcaggtgacaggaactatatacacatgatagtgtttcttgtccactccatgctgagcctctacttctcctgggtcctcctcctagaatggcattctgtaggttctttcctgcaaaatttctgttcatctctactctggcatcatttaattctgaaaaaaaaatttttttacatagacccataatgtcctacatgtaattcctttatagtatttgctatttcatatttttattaaaatgttttcagttatttttctattcataaagtgtatttatagcaggcaatttgaaaaatacagaaaaatatgaaaaaagacaaaggaaattattcagagagaaatgtactaacattttgaggtatattttccaatgtttgtttctatgtatatagtcacacttttctctatcttctctttcacacaacacacctatataaacacaaatgtaggtatgcaaaatcttatatattttgtaactacttttatattttacttaaaaatatgagtgttgttatagccttaagtgttcagagtaagctctttgaagaacaagaagtgtgtgtgcgtgtatgtgtgtgtgtagatatgtgcgtgagagaatgtgtaaacaaatacataaaaacatccagctgagtgaatagtatataatagactctaaataattattcattgaactaatttattaacaacaatgaaagagacatgggagaaagaaagaacatgagataagctggaacacatgcaaggtaaagagatgaagagaagacagcccaccatttggaaagcatttatgacttttaaagtttttatgtactctgtagttgatgctcacaatagccttctattttcttttattttatttttaatagagacagggtattactatgttgccgaggctggtcttgagcttctgggtttaagtaattctcctgccttagcatcccaaactgctgggattacaggcataagccaccacgcctagccacaatagctttctgaagtagctatagcaattatttgcaaatcaggaaagtgaaactcagagaggttaagtgacctgccctaggttgttcactttataagtggcagaactagttttttgaattcataaactatgtatttacattactttacacagcttctgggggaaaaagggcagcaacatgatccctaccaaggtctgggagcctgaaggggtattcacactgcctggcatggtgcctggcacagagtgctaaaacagtgattgttgagcacaactaaaaagcaaacgagagaaagaacaaacagtagacaatagtgagtatacagggtaaggcaccgcaatccacttttctccatcctcaccatgcttgtttgatctgaaaaagcctcctaaatgatctgcctcctgccattcaacacccttttcatctatcttccataaacacaaattgatcatgacaaatgatgtattggttccctttgctcttgggaaaacattcagaatattctcctagcttaaaaggttcttcaggaaggaacactttttttccatcttgatttctcatttttctttctcttgtacatgccactcaggcatattcaacaccactaaatccctgaaagtgctgaaacattcttttccctgctattcctggattactgttattttgataatttttttttttactagttgttattagttttctattgctgtgtaacaaattactgtgctgtaaaaatgtagcacttttaaaaagcacaaatttatctcactatttctataggttagaaatctggcacagtgtggttggtttatcttttcagggtctcattaggctaaaatccaggtagtatccagggctgcagctctcatctgggacgtatggtcttcttccacactcactgggtattggcagaattcagtgcctcatggttgtgggactgtggtccctatttccttgctgcatggtcctctttctcttcaagccaacaatggtgccttggtaatccttgtgctttgactctgatttctgcttctgccttctgttttaaggattcatgtgattacattaggcccatctggataatcaaagatactctcaccattttaaggtcaattgctttgtaacattacatctacaaaatctttttgccatttaatataacctattcatggatataaacaccagagagtgaagtccatggggagccaacattctgcctatcacaattatagcatcaaatttggctgaggggcccttcttataagattcatgctcatttatttctctgcctccatttctagagtataagcttcatgatgtcagtgactatgtctactgcacaaacctgatgtgttgcagctggcttgtccttgctaagaagtgcttattattaaattttcaggaatttttccatctgtttgttaaacatagctattattttaaaaaacaaattatattctcaaaacataataaatgctctaattcatttcctgtttattgtcatagtgtttactacgatttattctcttgaagttattttccccgattcaatccttatggtggaaatactatctattgagggactaccgcacatcttttcaacttcctgttcagtgccattattcggttggtgcaaaagtaattgcagtttttgccattacaatacattatgttggtagcttgaaattgacaatagtggatgtattgataccaaataaatcagcaacactagttgacatcttttttttttttccaggtggagtctggctctgtctcccaggctggagtgcagtggcgcgatctgggctcactgcaaactccgcgtccctggttcacgccattctcctgcctcagcctcccgagtagctgggactacaggcgcccgccaccacgcccggataattttttgtacttttagtagaaacggagtttcaccatgttagccaggatggtcttgatctcctgacctcgtgatccgcccacctcggcctcccaaagtgctgggattacaggcgtgagccatcgcgcccggcctagttgacatcttgatgtattgtttatttgattgtttagacttgagaaaatgatagtaaaaatgttaacagcacagattaagcttaaagcaggtcatgtctatagccattacacaaaaatttaaagaaatattattcttccggtatctaaaacctatgattcagcaaagaagcagctcatgatattgacaaacaaaggaagttacaacttaccacctaattttactttaatcttattaatacaaaagaatcaagtaatattcttatatgaactatattcattcatcagatacaaccatagcttggctaaaaatacaatagtttagcaaaaaataaaataaaaaatttctgtggaaacaaaatggctatattacatttaaaataaagagtaaattgtacactatacattctttacattaatgttttatattaaaaagtatacatttatgtatgtgtgcataaacatacatttttacaccatcatgaaacatttaccagcccaccactgaatgcattgaatatactcctagagctcatcacaatgcctagcacatatggcgtgctcagtaaatgtttgtttaatgaatgaacggatagaagccatggtctacatgattgaccagagaacacaggctgagtggaaagggaatagaggccagaaaagaagcaacagtttggggaagttgggaggattccaagaactagaggtcagttgagaatttctataagattctacagaagttataaagtaggagaccaaaaaataattaaaggagctgtgacaagacaaagcatctcaggggttagagaaagctagggactaaccatgtgcaaggccctgcactgttagtccactttaagttaatcttttatatactcacaaaaccttcatttatcctcattttataggcaaagaaactaggtaattaaagttaatcaactggcccagactcattcagctagtagagggtagaggccagagtgttctaaacccaaagcctgcactcttgagggctacaccaaatggaagtgggaacaaggctgtgaggagttgtaattcaagagcttactactcacagtgtgttctgaggaacagaagaggggatttttgttagaacgttgattctcaagccctaccccagatctactgaatcaaatctgtgttttttttttctgtcttttacaagatatactggaaatgcctatgcaccttgacacttgaaaaccactagtttaggaggcaattgtatcagcaggtaaccacattgcagatggtcattaaagtcaaagaaatcaagaagtactatcaggtatattgtaagattgaacttgcccaagtaaagtgagggtgctccttctagcatgtggcatattaaaatcacctagagaccttcgtaaaatgccaaggcattagtaattttaaagtgattccaatatataaccaaggttgagaacttatcaggagcatcacattagtcatgccgttcctctcagatgtgaacagtagcccctacttatcaaaacaaacaacgaagcaaatgtccgtggatctgacttgagaggctgaagcatctcctccccaggatataattactcttcagcctcacagtggtttttctagccttgctctttacacaatagccctgccttccaaccccagaaacagactggcttataggatttcacatttcatgtgcctctcacctggcacacccttttttctccttgccaccagaccacatcctttccttcctccagcccacatttatttctagacctaaaatgatttcttaatgtcaaccttttattctgcttacatggcatcatacccctcaccaggattaaactgtaccaaagatacctggaaacaaattgtacaaaataaacagaattttatggaggctacacagttctatttgttcaaatcaagtattatcctttttaaaaaaatgccactaaagctagtttcctctatctggatcctctgctgtgcagtaacaatacaaggcccacaaaagagggctgagttccttcccacatgcactgctttttctccagtaatagactgcattttggatgactgccaggcaacaatagttgactcgtgctggccagctctcaacataggtctccgaagaagctggggaacagggcaaattgacgcttctagttttctctcaataatccctccccagggttcaggttcacatgtggacttctgttaccaaccttgtttgatctctttaaagaggtcccttgcctccatttgggtgacatgaagtctccataagaacagcaataggaatacttaagatcttcttgtcacatgataaacagactgattagatcttctggtttagtgacttcctcttcactctcaccagctactgaaagtgtggccggtcgctttgattggggatataactgattctttgaactttgctccattcttaacagtattccaatactgtaattagatagtgggctgtatagactgaaaaatggttttgctaagtgtaatgggaattgtttccaggttaccctttcatcataagaattcactaaggcatgcaaaccaatttcatttatttcttcttctgtttctcagaaaagggccttttttagcagggtggtggtggggaggatggtgatagcttatagaaattccagaaaacaagggatggagatgaaagatgtttaaaacaagcaaaccaaaaccgtctctaagaaggaagtcaaacaaaattctttttgatatttgaaaatctttagttttgatttacgcccagacttgtactctgttacttaaaattccctgtatttaggttataacttctaggagcatagatactcatcttcattcattgattcatgcatacatacatttaatcattaattcattcatttattcagtaacatttactggatatttgatagaaacaaagggttcaggataaacaaaaataagacatgttccccaacctcaagtagctcagaatctaaaggagcagaaaatttctaaattgtccaaaacttatacaggtgctaaaatgtaaatctctagaaaatacagtgggaacccagcaaataccatgatcgactctgtaggggcagcagtagcagggtggaacttttttcttagtaaagaaagaagaaaattccagaaaagaaaaaaaaaagcttcagaaccaattttctataatcaaaatagaggtgctcagattttgtctagtgctatattttatatgaaactcatgtgtcaattggggtaaggcttccaattaagctaaggctactcagaacccccaggccatagtcgaagctttttctaagagttctatgaatctctggaggatctgggtttctattgttacttctagttctgagctcctgctcccataaatcagttctatttatgaattattttatcttccttgaatgttgcccctgacttacaccactttcactcatatatggactttcaggttttttccttgatcttaaaaaatatcaacaatatcatgcaggtatggtgcttgtaactgtaacatcagtgtagagagcaaagaaccgaatccctgtgtgaaccaatcctctatttgaaacaatccacagcttgtcttttgtccacccaggcacactggtgtcatgggctctttcttcatctcagtggcttctctctttctcttccctatgatcttttttaaagtggacttccaggattgctcctagcaattccaagtgcttttcatgccatgctgagtaatgcagttctcaccagctccaatcccaaaagtcagctcaaaggacatttttgcttattcaaaatcctctggtgtttaaataatccttggatggtacttttgttcccagaagaaatgcttctgctatgaacagacacttctcaaaagaagacaaccatgcggccaacaaacatatgaaaaaaagctcatcatcactagtcattagaaaaatgcaaatgaaaaccacaatgagatgccatctcatgtcaattagaatgatgattattaaaaagtcaggaaacaacagatgctggcaaggatgtggagaaataggaacgcttttatactggtgatgggagtgtaaattagtttaaccattgtggaagacattgtgatgattcctcaaagatctagataccatttgacccagcaatcccattactgggtatataaccaaaggattataaatcattctattataaagacacatgcacaggtatgtttattgcagtactatttacaataggaaagacttggaaccaacccaaatgcccatcaataatagattggataaaaaaaattggcacatatacaccatagaatactatgcagccataaaaaagaatgagttcatgtcctttgcagggacatagaggaagctggaagccatcattctcagcaaactaacacaggaacagaaaatcaaactccacatgttctcactcataaatgcgagttgaacaatgagaacacatgggcacagggaggggagcatcacacactggggcctgttggagggtgagggacaaggggagggagagcattaggacaaatacctaatgcatgcggggctgaaaacctagatgactggttgataggtggagcaaaccaccatggcatatgtacacctacgtaaaaaacctgcacattctacacatgtatcccagaacttaaagtaaaaaaaaaaaaaaaaaaaaagaaagaaaggatgcttctaatacaatctacttttcttaaaaagtgcttatcaatttcctccaagcaacattacaaccaatactcttcatatttgaggatgacgttactattcatcaaaacccacttttggccgggtgcagtggctcatgcctgtaatcccagtactttgggagtccgaggcgggtggatcacaaggtcaagagatcgagaccatcctggccaacatggtgaaatcccgtctctgctaaaaatacaaaaattagccgggtgtggtggcgggtgcctgtaatctcagctgcttgggaggctgaggcaggagaatggcatgagcccaggaggcggaggttgcagtgagccgagatcatgccactgcactccagcctggtgacagagcaagactccgtctaaaaaaaagaaaaagaaaggaaaagaaaagaaaaaaaacacactttcttttcttcctgcttttgttctggtattctttggagatggtttgcaagaaatccacttccattactgtagagctatgcctcactttgaactctaaacactgttagtctgaccacagttttgttaaatctggatgtcttaagcctctaaaaaccccaaacaccccaggaacaagtattactcaccaattatggtattaaaaatgagccactgtctctgagttcacttacttgttctataaacattaatcatgcaccatgcattaagttaagctttgttctgctctagaagagctcagagtctaaccaaatacaagttccaaaaaagctttaaggaaaggcaacatctttggaattcattaatagcctctcaaggggatggctttaatgggcaatcttcttttggagcctatttcccattcattagttaaaacatagatcctatgctttgccattgtgcctcgtatatgttctatctcctgcgatataatggcagtaatttaggagcatcccctgaaaagaaaaaacatttgtggagatgtaagttataagactcttttccccgtattgtgacttataaattcctctttcatatactcatacagcctagagcattatatagtatgttataattatattataattgtgcaattacttatctgtcccctctcctagaagtgagcccctggggcaggttatgatttatccaaattcagttcctagtatagtgtttgaaattgtcggtgtactcacagaagacctgggaaagaaaaggaaaaggaagggagggagaaaaggagaaggtaaggatgatgactatcgttagtgtgagtcagagtattctgcacaatttcttctatttggcacctgggaggctccccgttcaaaggtgtggtcagtcttccacagaattagcagatggctcagcacaaggacctcaactatcagctaaatcaggatgaatattttgtaaaaactgggattaaatgccttttgttagacgggcaaatgatactgaagtctcgttaatattttatgttaaattctatgacctgatactccataaatatcatagctgctagaaataatactgagattctaaccttaggttttgctttgtttttaatttaaaatgttatcaatttgtcatatcatagtgctgaattttgtgcccgcaaaattcagatgttgaaaccctaaccccagtacctcagaatgtaactgtatttggagataggaagtttgaagaggtgattaaagtaaaatgctgtcagggtgggccataatccaatctgactggcattcttacaagaattggaaatttagacaaatgaagagaagccaggtgtgtgtgcatacagaggaaacaccaagggagtggtcaatgagaaggcagctatctgcatgccaagaaaacaagcctcagaagaaattaaacctgctgacacgttagtcttgggcttctcgtccttagaactatgaaaacaaggccaggcatggtggctcgtgcctgtaatcccagcattttgagaagctgaggcaggtggatcacctgagctcaggagttcgagaccagcctggacaacatggtgaaaccttatctttactaaaaacacaaattttagcccagcgtggtggcaggcacctgtaatcacagctacttgggaggctgaggcaggagaattgcttgaacccagcaagtggaggttgcagtgagctgagatcacgctactacactccagcctgggcaacaagagcgaaactttgtctcaaaaaaacaaaaaaacaaacaaaaacatgaaaacaattcatttctgttgtcttagccaccagcctgtgctatttggttatgacagccctaaaaaaactaatacacttagcattgttctcaagctatagtcattgagactaatcctggctcttccactagccagcacttactttttaaaaatttaacttaaaaacttgaatgaatatccatcatggatgacactactaaaaaacaaacaaacaaacaaaaaaccacaaaaatgaataaataaatgaatggcatgagttatgaagtacaaagatctaaaaaaagttgcaagttaaaattgagaagaagtctaccgtatggtcctggataaatctcttatcttaggaggatctgagttgtctcatttctaaaataaggctgttggaaaaataacttattttatcccttaaaatttaggagcttggaatttactgttaagcacaacactgataatgttggtgatgatgatgatgatgatgatggtaaaaggtaaagaaattaaagccagaattttatcagaaagtatagaaagaaagtagaaagtataggttttctgctcctcccatttgacagaaagcctcatcttctcgtgcatcaccagcctcatccctgagacaccatggtgaaggtgaaggtggaagtcaacggatttggccatactgggcgcctggtcaccagggctgcttttaactctggtaaagtagatattgtcaccatcaatgaccccttcattgacctcaactaccccttcattgacctcaactacatgatctacatgttccagtatgattccatggcaaattccatggcaccatcaaggctgagaatgggaagcttgtcatcaagggaaatcccatcaccatcttccaggagtgagatccctccaaaatcaaatggggtgacactggggctgagtacatggtgaagtccaccagcatcttcaccaccatggaaaaggctggggcttacttgcagggaggagccaaaaggatcataatctctgctccctctgctgacgcccccatgttcatgatgggcataaaccgtgagaagtatgacaacagcctcgagatcatcagcaatgcctcctgcaccaccaactgcttagcacctctggccaaggtcatccatgacaattttggtatcatggaaggactcatgaccacagtccatgccatcgctgcaacccagaagactgtggatagcccctctgggaaactgtggtgtgatggatgcagggctctccagaacatcatccctgcctctactggtgctgccaaggctgtggacaagccaaggtgctgccaaggctgtgtcatccctgagctgaacaggaagctcactggcaaagccttctgtcgtccccaccaccaacgtgtcggtagtggacctgacctgccatctggaaaaacctgccaaatatgatgacatcaagaagtggtgtagcaggcatcagaaggccccttcaagggcatcctgggctacactgagcacttggtagtctcctccaacttcaacagtgacacccactcttccgcctttgatgctggggctggcattgccctcaacaaccactttatcaagctcatttcctggcatgacaatgaattggctacagcaatagggtggtagacctcatggcacacatggcctccaaggagtaagacccctggactgccaacccgagcgagagcatgagaggaagagagaggccttcactgctggggagtccttgctgcactcagttccccaccacactgagaatctcccctcctcacagtttccatgcagaccccctgaagagggagatgcctagggagcccctccttgtcacgaaccatcaataaagtcccctgtgctcagccaaaataaaaaaaaagaaagtaaaaagtataagaagaccttagaatcaacagatggcacatgtttgccttgacttaaagatatgattagaaaccaatattgttagtctgaggagagaaaagttgcaaatctataatgcaattgtattttatcacaataggctaggttgtactacatttaaaaacaacgtccaaatctcagcatccaaaaaataattgatttatttctctttttcattgtaaatttcaggtcagcacagctcatactagtaacgcaggcacccactctgataagggtttaatcttcaacaattactttggcagagaaagagatgggagcaaattaatcatggctcttaaaatttctgctcagtagcagccatatgccaatttcattcagatttcatgaagaaaagtgaagcacatgagtatgcctaacatcaaagtgagtgggagtccaattttttctgtgtgatggaaaggacaggaatgaaatatttggcaatagactggtgatgattgacagccaaactggtgaaggatgctcacaaaattggattgtgtttatgggtgaacataatttggaaattttaatctattacacctaggaaactctgcttgaagcttaaaagagttaatttaaccacaagaacgaggagacggagaaggaggaggagacttatctcttatattaagaaataaattcatgaagttctttacctcaagagttgctacagactaaaaaaagcttcagaaaaagtctaaattagtacatgaaattgtctccaagtcaactgagaattaaaaattttaagatatctcaacattcctagttgctgaatcactcagttggttttttatttgttgctttggttggttggttagttggttggttggttagttttgtaaacaagtaagcttggtattaacacaatgtgctaatttagtggtgacaacattactgggtatccataaaacaaatatagtgtgtcttgaaatttgaattttctgtcagcccatgttttacctattctatctgtgaaagaagacagtccactttgtagcctaaaatacattgggggtaaaaaatccagggaagccaccctcatcattgtttagtatataaattgctctgaatgcctattaagtgcagtctctctgctagacacttttcatacactatcaagtgtgctcttctcctcaacctagagatgtaaagtgcagtgatcctgaactgttctcaaaggcttgtagggtcacgattcacagacatgtgacatgaaaccatcctctctctcctggaaaaaattaagtttgatcaagtcacttgtggctctaatctcgaatatagtatcaaagcctttcccagtgattacttaggtaacaaagaaagttaaaaaagcataaggtcatattgcccttttgaattactgatcaaatcatgtccatgaactatgaacttgggcagacttcttttagtttccagtcttcatccttaaagagggaggtgatctttttaataagtctttcaaaaaaattttaaaatctcaagcaaaagaaggcccaaaaaacataaataggaaatatatatatgtatacacacacacacagacacacacacacgcacacacacatttatcttgaaatcccaaacttaaaccatttttcttacaaaaagaaaaaaaaataattaatttgtgtgacaaaggaaaaagagtctcttctgatcattgttgaagaatcctggaagaagtgttattggttcaatgttacagatgaagaaagggaggtcaagtcatcaacacaaaatccaaaactgatctctattcactttcactttctgaatcctcatctccctttttacttctttctatccagctcaaacgcctgccttttcctgctcgctgccagaatttctgaatccaggatcagggaagtccccagtgagctgcattctcaagaaatacttatacacacctccccacctgcaggcttttcccagacctttcatttgtttcctaaggggttctgagagacatttacttattaatgtttgtatcaggatttatactttaaaagaaaatttgacatggtgattgcatttggtgaaacaaggaattcttcgcgttcggaccaaggaacttcaattggaaagaaatgtgagtaaaggcttttctggtgtccttgaaatcatactaccacactaccagccctcattgagtgatggctttaccctgattcttctaattcagatatcagaaatctactattcaaagatgattacccttgagaaagactcataaattaggaaatttaaaccaaaagaaaaggattcaataatatagggcatgcagggaatgagttcagacacttaatccaaccacagtgtttaaaagcagagaaaatccatgagtactcctgttgtcattggctcagagatgggtcatctactttctttgtttttttctgtcagtcatttagcctgtggctctcctctaattaaaactcccacagatgtttccagactggctattgcactcttttgtcacagcacactgaatctctacattgtatagagtatgatctcttttagttggtgctcagaagcatttgaacacaagactggcataaggataatcagaaatgatcagaggcaaatctgtagctaaagagatgatatccaaaggaaatctatgcctaccaaaatttcccctatacttcagttaaagaaagacaggaaaacaaatagagaagctagtttccagcaagttttgatcctgccctcattttcccatggctatgtggcacaccaacaacacttcagttgaatttccttgttggtacttgtctggtctctttttttccccagtgttgcaacttgattacctaagcctcatcaacccacttaaacaagcataaatgggaatttccactaaacacatttccaaagaatattcaatattgttcattgaagtgaattatctaatgtatgaaaaatgaagcagcgtgaattatctaatgtatgaaaaacactagttaacccctttcactatcatcacccttctattctagccttttaatgttcagagagatatttagaatatccctctttgctgagagctctacacacatttaaaaagctaaatcaaatagatgagtctagaaacgaaatgtgatgtggcaatgggacttttttctgcggcttctcattagatatctgggctctagagactacaagttgacccacagcttaataaatttacatagaaatttgttgaagaatcctggaacaattgttattggttcaatgttacagatgaagaaagcaaggtcaagtcatcaacacaaaatccaaaactgatctctattcactttcactttctgaatcctcatctccctttttacttctttctatccagctcaaacacttgccttttcctgcttgctgccagcatttctgaatccaggatcagggaagtccccaatgagctgcactctcaagaaatactgatacacccctcgccaccctcaggcttttcccagacccttcatttgtttccttaggggttctgagagacatttacttattaatgtttgtctcagggtttatattttaaaacaaaacttgagatggtgattgcttttgtatgagccattgcaatcgatgtatcatggatacatggatacaaaggagaaaaaatcttagttcctgcccttatgttttccaccgtctctcatcacaggaagagagaagtaataagtaaattaacctgtaactctactggtgactgtagaaggcagacactttaccaagtgatattaaaaataatccttagagaggagcatgaagtggactggtgcttccatgatgttgatgatgttgtgattttttttaatgtaggcatgttcagtttgtgcttttatgtgctcttttctgtatgcatttctatatggattttgcctgtattctgtatttctatattctttatgcattatcttaattttaaaaatgctttaaaatcccttacatgaattacatatatttagctctaaatccagcattgtttcccaataacatcttagtgatatatttactacttacctaagcatgtttttagacaaggggggataaaaacaaatgaacagcaaccaaaacaatgtttccttacttaactgctacagtatgccatgcaatgatcaggcattatacctcgaaagccatagtgaaggaaagaattgtcttggccacgataactctcaaactgagacttagggctggctgttctgtgctttcaggcacagggttcacggcatgaaggagtgaggaaagaaacaagaatctgaagacatctaggtgaaatatgctctttccatttaattaatagcccacaccatttactattattttctgcccatctgtttcacatattctgcccacctggacggcccaagagagcattcaaatttcccaagcagttctaggctcttctattctcactgctctctgtgcattttaatctttcaggtcagcatcaagctgtatgaggaatcaccaagcagcctcccagatcgccaagcagctaccgcatggtaaacacaaatctataggccaggctaggtagtgccccacatcaataaaactaagagttagctatcttctattatagaaactatggaaaggctagtgaactcctcattaaccttttaagtaatcccagtcagcactaccatccttagtgcagcaagttgatccagagctcaacacatttataaccaaaggagtaaaaacaaaaatcataaccagtttttattctctaagataaaatggtaaccttcatgtatttcaggagatgataaaatattttccttcggtcttatccttttcattccatctccatccctgcatccttacctccctgtcccagccatctcctctgctcctgattgctaagtcactgttaataatgcggtggtccctcggactatgaggcattcgatgacagtgcttttgtcttactcatcttgcctgcacactgcgtaacacagtgctcaaaccagagtcactcaataaatatgggttaaataatgaagaaaaacatataaagaccaaactatatgagattaactatattccctaaaacataagaatttagtctgctaaaaacttagagcccaatgtaaaagattagaaatggaaataatattatatctactttaatataacccccttgtttaacaagtgagaatgcagatacccagaaaagtcagagagacagctgggaaaaagcctccctccaggagtcacactaggttcaccaccctaggagcagtcttttctgattaacttcccattctcatcacttgaagttttggtattgcctcagccagccacccaaaatgttctcatgattgtttttttctctgatttgctttttgtcagttaagtaacttttgttttgctttgttttgttttgtttcatgagtcagactcctctcaataactgtagtgaccttttctcaaccttccagctacttctcatttgtttaaacattctctaagttgcctacattccaactgtttattcatgtttaagatagaatgctgttaaaaactgtgtctattaaaagaggggttagaagccctatcccgaaatgtgatgtgagttagtggagaaggaaaaacggaagtgtcccaggctggtgaggaaactcaccagagcctggaggataccaagtcagacaggacacacacaggaaatcttgataagcagcccccaaagacattctttgcaaaagaataaaaataaatgaatgagacggctcatctgcaacatctttccaaaatgtaagcaatgtaaaattgaaacaaggtctaaagctggtaaattcattcaaatatttatttcttcaactaacatttagaaatcatgtttatttttaccaaatctcataccagataactgggttatagtacaaataagtcaatcccctcttcaaggagtttaggttaaaggaacaaaggaatgttagacaaaatttcccagatgtattgatgttgagcaagggtctaggtttatttcaaactgtcaataagagtactcacttcaaagaaagccaattcaaatgttgcttctgcaaagagtgtctttctagtaaaagccaaaataaatgaaaatgacaaaaaattcttatcttgataagagtgttagtctaggtactagaaaggaatgtctgctaaagtttttgatctattcacaagattttaagtttgtaatactatcacacatgtatcagctttgtaggctaaactctaacttcactgattgggatgttaatcagaagtattactaattgataaagaacgattcttaaagtatcaaaaagtattaatgttttgctcaggtttgagacatttgtttctttctcactacctaaaatttctcctattaaacggtgagacgtacatactgaaattagaacacatattttctatcatgaatacagatagtcaccagagctttttgtgactgataagaattattagtaaaagtgaaaaacaatggtataaagtgttcaatgtttgtttcattgagttataaagatacatgatcagtgtcctcactgggagaatgtcaatggttttctgttctttgccacaacctagatgaaatattctctcaactaatatattctcttcactctgactctcctactcaggtattattttcatcagatattcttttactctgctagtggtgaatagttctgtgtggtcagagagacgtggttttaatatctgccccaccacctaaccaggtttggatattggaaagctatttaaactttctgaacatctctttccccatttctaaaatggaaataatttcccatcaaatagaattgtttgaaggttacaaaagataaggtatataatgtattactctcacaaagtaagcattcaataaattataattactttaattatatcatcattatcattatcatcaccaccaccatcatcaccaccaccaccaccaccaccatcatcatcatcatcatcatcatttttttcagccactgtgagtattctctgcccattgcatgaagtagacatcaaagaatcttaggtttgattctttgcttcaaaacttggtagctttgaaatgaggtgagattatttaatgttctcatttgaatttctcatctataaaattgggataaagaaagaactacatcactgtgttgtagtgacaactaatttaaataatatgagtgaagtgtctactattgtatggagtaggttctcactaaatgacatttcctttacccaatattggcattaaatttgttgatttgtaagcttcattagtctgatgcagtcccctagggcctgctcatccttggagaaggtaatcaaatcacattacggatcctgcaaaactgcagacaggatcagggtctctcattaagatatattcacttaagaagctccatcccatgaaataattagttcctggtttaaaccaagtgtaaatatattaaaaataaatgaaaatgacatatgtatatatggtaactgagttccatgtgtgtgcataagaggggtaaaagataatggttagaaaattcctgtgaatagagtcaaggggagagtttcatttgaggtccatttggctgctaatcacaagactcatttctcatgggtacacatcctccctcaccaattccctggctcactcacacgtcctgtgcattgggatctctgttccaggctccagccattatgaactacctgctattttctgatgattttgtgatcctgcatttcaatgtctctgtaacctctagtccctctgtcagaagtggctctatacccctttcacttacctttcttctctacctacataccttttacaactcaggtgaaatatcaacttcctctaaaaatactttcttctctcattccattaacctccttcctctgtgtttctttgtcctctatcttgacctttactattgacatcccatgcaacatattttattctgcaactcttctaagcattagaattcttttggtgtaggcacttggtcttatttgtccatttataatttttttggttcttcaaggtgcagctcagctcaaataacacagctccactgacacttgcctatgaagcttttctaaaataaccagatatctaggctttagacttgattgtatatcccaggtcttccattattaattttcatctttgattggtcactcacagacttcaaggttcttttttaaaaatttcatctgtaaaataaagatatgtcatttatcttatcgaataattgtaaatggccaaaacaacgtatagtgcaaagtatctagtgtctaatagaagctcaataatcctaataattatttctattcttctcagaatgtttttggcatttttattgtatcatttatttaacatattataccacattttgccttgtattattagtgtctatgcatttgtcctctccctgtcactggattttagattttgctcagatgttcttccttaagcatgtgtctctgcgtgcatgtatgtgtttttgttagtagaatttatccatggcataaagccaataaatgagcactgaggttctcatcagaaaagagggtggtgtcaagatttaaactaaggtagataaacatgagaaacacacaaacattcaagaatcctatataaacaagcacaaaatatatctcagtaaacattaacatactatatgaactatagaatgttagacaaacactaagaattattattagaagtaggataaaatttgagttaaaatcgtgcctgttctacagttaccattaagagttcatttcataacttcttccatttctttctttctgtaagaaatgagaaaggatgacttccagatgagggaaattaaactcctgggtcaatttttatcaagaaattatgtgatagaaccacacacaattctgtaactattatttcccaaacactgtggggaagctctaggcatatctggtgtaagcaaacagagacagactgcagcacatgacgaattattcatgtatactagagagaaacttgatttttgtcaagttctaaatttgaggtacacagcaaaaaaaaagtggtcttaaaatattttttgtatttcagatacacagattttttccatcccacaggaaatcgacaaaaataaatacaccaaactgtttccctgtatggtagtttccttttatctatggtttctctttctgtggttttagttgcctatggccaactgctgtccaaaaatattaaatgaaaattccagaaataaacaactcataagtttaaagtgtgcactgtcctgagtagagtgatgaatcaggggctgtttcactctgccctacccagggcatgaatcatccctttgtcgaatgttatccacactgtatttgcttcctacccattatcagatccactgtcacagtatcaggttatcagatccactgtcacagtatcacagtgtttgtgttcaagtaacccttattttacttaacaatgcttaactaataataaatttattagttactgttgtcaatctcttatggcacctaatttataaattaaactttaccataagtatgtatgtataggtaaaaacatagtatatgtaaggttcagtaatatctatggctttaggcatttaatgaggatcttggaacatatcccccagggatgaaagggaaccattgtatgtaaggttcacctttgtgttagtattaagatattgttcccaaattcgtttctcaggaagttgaattttagctttgaagttgttgatccttgtgtgtttctaagaaatcaaatgttaccaagtggttactaagtagaattaagaattgggactaaaataacgaataaagacaactaaatatatttcatgccctcattttttttgaagccttgaagctaaaagttgcttttttaaataaaagagttcatgttatgaccctagttgaaaatacttctatcattgccattttactctgcagagcattaaactaacatggaaactaggttgcttctaattatataaagatgggaatagacagagccttttcatgtttggagctctcctgcctgctctagggatttatatttaaacaaaattcaagaatatttgtgttagtccacttgtgttgctataaaggaacacctgaggctggataatatataaagaaaagagattaaattggctgaggttttgcaggctttacgagcacgcctccagcatttgcttccagtaagggcctctggaagcttacaattatggcagaaggcaaaggagagcaggcatgtcacatggtgaaagacggagcaaaagagagggagtggggaggggccaaatgctcataagtaaccagttctcctgtgaacgcacagtgagaactcactcattactgcaaaaagggcaccaagacattcttgagggatctgtcccatgactcaaacacctcccaccaggccccacctccaacactgggaattacatttcaacgtgagatttggagggggtgcccatccaaacaatatcagtattcaaaaatgtttatttcttaaattaaatttaaaaacattctaacaatcaaccctaacacatctagggcaaaatgtgtctgaagagtactcactctttacatatataaactctcatttcttcaataataatgacatatgaaacatctattatatgtgaggtacagtactagttactttatagattatacctgttggtctgagtgcaattcccaatctctctctctcactggatacacacacacacacacacacacacacacacacacatacccataaaaattctggaaccaacaatcttagaaaagatgtggccagctaaatctaccaccctgtttttcctaataatgtcctgatgaaagccatctcatgggcagagacacacataggctcaaaataaagggatggaggaagatttatcaagcaaatggaaaacaaaaaaaggcaggggttgcaatcctcgtctccgataaaacagactttaaaccaacaaagatcaaaagagacaaagaaggccattacttaatggtaaagggatcaattcaacaagaagagctaactatcctaaatatatatgcacccaatacaggagcacccagattcataaagcaagtcctgagtgacctacaaagagacttagactcccacacaataataacgggagactttaacaccccactgtcaacattagacagatcaacgagacagaaagtcaacaaggatacccaggaattgaactcagctctgcaccaagcagacctaatagacatctacagaactctccaccccaaatcaacagaatatacatttttttcagcaccacaccacacctattccaaaattgaccacattcttggaagtaaaactctcctcagcaaatgtaaaagaacagaaattataacaacctatctctcagaccacagtgcaatcaaactagaactcaggattaagaatctcactcaaaactgctcaactacatggaaactgaacaacctgctcctgaatgactactgggtacataacgaaatgaaggcagaaataaagatgttctttgaaaccaaggagaacaaagacacaacataccagaatctctgagacgcattcaaagcagtatgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaaacccttcaaaaaattgatgaatccaggagctggttttttgaaaggatgaacaaaattgatagaccgctagcaagactaataaagaaaaaaagagagacgaatcaaatagacgcaataaaaaatgataaaggggatatcaccatcgttcccacagaaatacaaactaccatcagagaatactacaaacacctctatgcaaataaactagaaaatctagaagaaatggataaattcctcgacacatacaccctcccaagactaaaccaggaagaagttgaatctctgaatagaccaataacaggagctgaaattgtggcaataatcaataggttaccaaccaaaaagagtccaggaccagatggattcacagccgaattctaccagagatacaaggaggaactggcaccattccttctgaaactattccaatcaatagaaaaagagggaatcctccctaactcattttatgaggccagcatcatcctgataccaaagccgggcagagacacaaccaaaaaagagaattttagaccaatatccttgatgaacattgatgcaaaaatcctcaataaaatactggcaaactgaatccagcagcacatcaaaaagcttatccaccatgatcaagtgggcttcatccccggccgggatgcaaggctggttcaatatacgcaaatcaataaatgtaatccagcatataaacagagccaaagacaaaaaccacatgattatctcaatagatgcagaaaaggcctttgacaaaattcaacaacacttcatgctaaaaactctcaataaattaggtattgatgggacgtatttcaaaataataagagctatctatgacaaacccacagccaacatcatactgaataggcaaaaattggaagcattccctttgaaaattggcacaagacagggatgccctctctcaccactcctattcaacatagtgttggaagttctggccagggcaattaggcaggagaaggaaataaagggtattcaattaggaaaagaggaagtcaaattgtccctgtttgcagatgacatgattgtgtatctagaaaaccccattgtctcagctcaaaatctccttaagctgataagcaacttcagcaaagtctcaggatacaaaatcaatgtacaaaaatcacaagcattcttatacaccaacaacagacaaacagagagacaaatcatgagtgaactcccattcacaattgcttcaaagagaataaaatacctaggaatccaacttacaagggatgtgaaggacctcttcgaggagaactacaaaccactgctcaaggaaataaaagaggatacaaacaaatggaagaacattccatgctcatgggtaggaagaatcaatatcgtgaaaatggccatactgcccaaggtaatttaaagattcaatgccatcctcatcaagctaccaatgactttcttcacagaattggaaaaaactactttaaagttcatatggaaccaaaaaagagcccacattgccaagtcaatcctgagccaaaagaacaaagctggaggcatcacactacctgacttcaaactatactgcaaggctacagtaaccaaaacagcatggtactgttaccaaaacagagatatagaccaatggaacaggacagagccctcagaaataacgccgcatatctacaactatctgatctttgacaaacctgagaaaaacaagaaatggggaaaggattccctatttaataaatggtgctgggaaaactggctagccatatgtagaaagctgaaactggatcccttccttacaccttatacataaattaattcaagatggattaaagacttaaatgttagacctaaaaccacaaaaaccctagaagaaaacctaggcaataccattcaggatataggcatgggcaaggacttcatgtctaaaacaccaaaagcaatggcaaccaaagccaaaattgacaaatgggatctagttaaactaaagagcttctgcacagcaaaagaaactaccatcagagtgaacaggcaacctacaaaatgggagaaaattttcgcaacctactcctctgacaaagggctaatatccagaatctacaatgaacttaaacaaatttacaagaaaaaaacaaccccatcaaaaagtggacaaaggacatgaacagacacttctcaaaagaagacatttatgcagccaaaaaacacatgaaaaaatgctcaccatcactggccatcagagaaatgcaaatcaaaaccacaatgagatgccatttcacaccagttagaatggcaatcattaaaaagtcaggaaacaacaggtgctggaaaggatgtggagaaataggaacactattacactgttggtgggactgtaaactagttcaaccattgtggaagtcagtgtggcgattcctcagggatctagaactggaaataccatttgacccagccatcccatttctgggtatatacccaaaggactataaatcatgctgctataaagacacatgcacacatatgtttattgcagcattattcacaatagcaaagacttggaaacaacccaaatgtccaacaatgatagactggattaagaaaatgtggcacatatacaccatggaatactatgaagccataaaaaatgatgagttcatgtcctttgtagggacatggatgaaattggaaatcatcattctcagtaaactatcgcaagaacaaaaaaccaaacaccgcatattctcactcatagatgggaattgaacaatgagaacacatggacacaggaagggaaacatcacactctggagactgttgtggggtggggggagggaggagggatagcactgggagatatacctaatgctagatgacgagttagtgggtgcagcacaccatcatggcatatgtatacttatgtagctaacctgcacattgtgcacatgtaccctaaaacttaaagtataataataataaaaataaataaataaaagaataatgtcctgatatggtttggctgtgtccccacccaaatctcatcctgaattttagctcccacaattcccatgtgtcatggaagggacccagtgggaggttattgaatcataggggagggtctttctcgggctattcttatgatagtgaattagtctcatgatatctgatggttttacaaagaggggttcccctgcacaagctctctctctctttgcctgccaccatccatgtagacgtgacttgctcctccttgccttccaccctgattgcgaggcctccccagccatgtggaactctaaatccattaaacctctttttcttcccagtttcagttatcagcaatgtgaaaatgtactaatacagcaaattggtaccagtagagtcggatgttgctgaaaagatacccaaaaatgtagaagcaacttcagaactgcagaggcagaggcagaggttggaggtttggaaggctcagagtaaaagagaaaaatgtgagaaagtttggaactccctagagacttgttgaatggctttgacaaaaatgctgacagtgatatgaacaataagtttcaggctgagatggtctcagatggagatgaggaacttgttgaaaactagagcaaaggtgactcttgttatgttctagcaaagagactgcagcattttgcccctgccctagagatttgtggaactttgaacttgagatagatgatttagggtatctggcagaagaaatttataagcagcaaagcattgaagacatggcttgggtgccgttgaaggcattccattttataagggaattagagcataaaagtttgagaaatttgcagcctgacaatgcgatagaaaagaaaatccctttttctgaggagaaattcaagcttactgcagaaatttgcataagtaatgaggagcaaatgttaatccccaaggcaatgggggaaatgtctcaagggcatgtcagaggtcttcacggcaatccctcccaatacaggatcaggcctaggaggcaaaagtggtttcctgggccaggcccagggtccctgtgctgtctgcagtctagggactttgtgccctgtgtctcagctgctccagctgtggttgaaaggggccaatgtagagctcggaccatggcttcagagggtgcaagccccaagccttggcagcttcaacatagtgttgagcccgtgagtgcacagaagtcaagaagtgaggtttgggaacctctacctagattttagaggacatatgggaatgcctggctgtccaggcaaaagtttgctgcaggggtggggccctcatggagaacctctgctagggtagtgcagaagagaaatgtggggtcagagcccccagacagagtccctactgggtcaccacctaggggagctatgagaagaaggccattgtcctccagacccaagaatgatagatccacctacagcttgcaccgtgtacctggagaagccacagacactcaacgccagcctgtgaaagcagccaggagggaggctgtaccctgcaaagccacagaggtagagctgcccaagaccaggggaacccacctcttgcatcagtgtaactgggaggtaagacatggagtcaaaggagatcattttagagctctaagatttgactgccccactggatttcagacttccatggggcctgtagcccctttgttttggccaattactcccattggaatggctgtgtttaaaaatacctgttccctcattgtatctaggaagtacctagcttgcttttgattttacaggctcataggtggaaaggacttgccttatctcagatgaaactttgaactgtggacttttgagttaatgcagaaatgagttaagacttttggggactgttaggaaggcttgattgattttaaaatgtgaggacatgaggttttggagcggctgtggtggaatgatatggtttggctgtgtccccatgcaaatctcattttgaattgtaactcccacacttcccacatgtagtggaagggatacagagggaggtaattgaaacatgggggtggtctttctcatgctggtctcatgataataaataagtcttacaatatctgatggttttataaagagcagttcccctgcacaagctctttctctttgcctgccaccattcatgtaagatgtgacttgcttctccttgccttccaccatgattgtgaggcctccccagccatgtggaattgtaagtccattaaacctctttctcttcccaatctctggtgtgtctttatcagcagtatgaaaacggactaatacatgtcccaagatgtaaaactctttgttcaaatgtgcttttacgtactcagttactctcatccatctcctcatccatctttccatacaaacatccatctaataattgaagcttttaaaaagtatgcatacagtacttgctgtaagttaggcacttccctgtgggatgcaaaacatacatggctccttttcttagagaacttgcagttggataggggagatagacataaatcaattagttacctaaatacttatataattatacattaaaacatgagctattgtagaaaggaatcctgtgctatgagaaagaataacaataaagtctaatttaatttggcagcttggaaaatcttttcaaagaaatggcttttaagtgtatttctaagaatggttaggagtttgttaaatgggaaatggcaggaagagaattccaggaaggagctctcgaattgcataaagttgaacaacattgaacaaggtgtgagccttggtgaaactgaaggagggctagtggggtaggaatatagtaagttgaggtaaaggtagaaggaagcagtagccaggtcatggaggaaacacaatgcctttgagaagattttaggccttttggaggaaccaaaatatccattagtagttttagacatacttcattaacctgccctctgcctccaatgtggatacactcctcactccactcaagctacagtaccttctactgctctggccctaccataaggacatcctcctcatccatttcctactccagcaccctgtgctaggccacctccctcactcttgggctgtgaggccatcactgtagcatcgtcctataaaaatgccttcccattccctttgggctttgtctcccaatctgtgccaccatgggtgtcctcccaggacagacacttacaacgtgcgccatgtaatgtttttggactgaatgatttatgaaagaaaaaaataaaagaaataaaatgaagagaaaagaaatgaagtaaagtatggaggaaaagaagaaaaataagaacattttaaaaagatgagaaaaatttaggctttgggaaaacaatactaaagtcatatgttttaaagagaccctaaagagtacccagtttagttatccctgaagctggcaaaatattggaattacctggaggacttttaaaaattaagaatcatgaatgacctgatggagtgggtgttattcaacctctgataacctgttaatgatgcattctggtgcaaatgttttcagtctcccctatgcaggaccctgcagttgcctggaactttaagagactcgtgtgtgtgtgcgtgtgtgtgtgtgtttgtaagtgggaaaagtgtgggaaggaatacatctaataaaatctctccacttccactgcaatcaggacaaaatagaactccgaatatattttctgtacttatcattcatgcagtattttactagaaggtttttctgttttaaaacagtgtgaaagcattgcactagagtatctgggttcccttaatcacacatagaagataaaaaggaaactagagagtctcactgcatttggtcttcactataatgaaggcaaattctgaaaatactcaaggatcttttttgaaatacaagtattcttcagtgcaacagaaattactccaatttgccaatctcctttaatattgtatctaataatatttatcatttaataatagtttaaacctacctagaaataactttaattcttttatagacagggacaattcaaaaaactcatttatgcttctgaaaaaaacacccaacactttggaaacacaaatatttacaaaagatttgctagataaattatgacaaatattgtagctatagttactttttgatcactgggcagattaaatacaaatacatatgaagatttttcaggtcacaaggacattcatttgttacctatttatcatgagctctcagtgggttcagcaccacgcaaaataatttaaaaatggtcaaatctctaaagaaggagttcatattctatctggaaagacacaaagaagagaaaaaataatgcaatgatatttgtacaagtataaagataaagagagagggttctgtggagcccataaaagggcacataagccagtgtgggagttttagataaagctttctataggaggtgaggttagagctacaaagcttattcccattgattattttaaaactgccttttgatgtagcctagatgaacttcagcctataaagttccctttgttgcattaacctcaatgcaagatcatctaacaagctctatgccttatttagataagcattagtggtcagatttttgaatcatgtcatcatttattccttccacacctcatttaataagcattaatggttttgtttttgtttttgtattttttcatgtctgtttattataaatatttgggagctttcctgttataggagaaggtagaaaagatctgaagttagtctagattttagaattggatcctccacttattagtaacttgaccttggcaatccatgtaaatatttacagttgcttcatttgtaaaattgacataaacatatctttctagctagttgtgtatcatagaattaagcaatatatgatcatatctttgtcatgtttaatatgtttcctagatgttgaaactctttgataatgaagtgcatctttctgttatgtttaatatgttttctagatgttaaaactgataatgaagtgcatactttctctctttttttttttttttgagatggagtctctcactgtcacccaatctgcctcccaggttcaagcaattctctgcctcagcctcctgagtagctggcattacaggtgcccgccacaccacgcccggctaatttttgtatttttggtagagacagggtttccccatcttggccaggctggtcttgaactcctgacctcatgatccatccgccttggcctcccaaagtgctgagattattaggcaggagccactgcacctggccaggtgcatactttcatcattttaaaataatgaacttttttctcaaagtgatgacaagctggttctaatagtattataatgcatctgtactggcaaagtggtaagtggtcaatctatccaaatgttatttgcaaaggtaatacaaatctagtatgcttcttatatgagaagtgtgagagatgagccaatataaataaactaatagaccatcattttatgagtttgaaaatgtgtaaatcattccaagctagaggaaatcagagaaagcttcatggatgagtaacatttgttctgtaaggtagatatattttcaaccaatggaacaatataagaaagatatagggatagagtaagacgtcttttgttgttagcaaattctcattggaacacacagttaatggaagcgtagatatttacatatgaattagggtctgagctgtaacgttaagtcaagaagcttagattttgtgcaaatgataatataagagcatatttaaataactgagtgacagacttaaatctgaaacttaggggaattaaaattattcttgcaagagatttggggagaggagaaaaactgcgggattggataaaattgtcaaatgcagactacctactaaaatctactttttaaatactgttcactcattcaataaacttatattgaggatctcttatgttccaggcaagttgtaggttaattccttattatcaatttgtttcatgtcttttcctagtttatgggtattattttaaaaataaaaatgactgcccatatcttgacttctaaataccattctccatgaaatgaaatgagcactcattggagaaatgactggctcatgggctggagcagagaaactacaagatgaatctagaacatcttttagtaacagaaagtacgaagagtctaaataatgatagggcttgtcaaaggacacaggggccagctctaagcagttcccttgggcaaacctagaaaaactagaacactgccaggcccagtggctcacgcttgtaattccagcactttgggaggctgaggcgggtggaccacctgaggtcaagtgcaagaccagcctgaccaacatgcgtcatggtgggcacctgtaatcccagctacttgggaggctgaggcaggagaatcgcttcaaccgggaaggcggaggttgcggtgagccgagatcgcaccgttgcactccaacctgggcaacaagaacgaaactccgtcttaattaaaaaaaaaaaaaaaaaaaaaagaacattaaaataatgatagcaaaggattatagcccatgaataaagaattcttaagttcacactgatataaataaaatatgtaaatatataaatttaaaaaatggaaagtttgtcctcccagtggataacgaaatggataaggaaatataaaattacaaaattacaagttgtcaaccagcataataattgatccaggcaaaatgtgtcaatacttgctaaagctagtggataaaatttgagagaatataggatatttacaaatatacaaagtatttccccatagcaacattatgtaaaaagtggaaaaaatgtaattttcagttcggaaatgtagcaatcaaggaatcaaagttaacgtcacaagtaatgtgattaatagatgccatataccatgctgatacacacaaacatatgaaacacccaaattgagagatatctacaattaaatgatctatattcttcaagaaaatttcaagataagccagttaggatatagaagcctgaaaaatcacatcactttcacccaagcaatgagaaaaagtagaaaaaagtctacaaattgtaattgtatttgagccaatcagagaactgagatcacaaagcaatcaaggaaatggaatcctaaggagtgatgggttcctgatgagagatgggacacatgaaatatgttacatttgggagcacacagaaggaagagatgatcatcataaaagcagttagaagaatacaactgatattttaatgaatttctaaaagctagatgtagatcagtgtgaatttaataccctgggagtcctagatacatgggaagcccattctttctcactggtttgtttgtttcactgccccttgcagagcagggataccccacaggcagtgtgcccagagtagccctcactagtttgttttttttgtttttgtttttgttttttgttttttgttttttgagacagaattttgctcttgttgcccagactggagtgcaatggcacaatctgggcccactgtaacctccacctcctcggttcaagcaattcttccacctcagcctcccaagcagctgggattagaggcatgtgccaccatgccaggctaattttgtattttcagtagagaccgactttctccatgttggtcaggctggtctggaacttctgacctcaggtgatccacctgcctcagcctcccaaagtgctggaattacaggcatgagccactgcacctggcctcactagttgttttccatgtgcatccatcacgtgttcatgagaaaggtggggacggggacagagacctgaaagagctgcattagtgacatgggatgctgcgcctggctaggtgtgtgggtggaggaggagcacttggagaagcccattttgtactctaggccctgcatgagtataaggtggggattggctgccacttgggaatagaaaggaatgctgaggcttctgtggacagggactaggacagggactatgtaagtttgaggctgcagcaggagagccaagaaaattctgctcccgccttactctcagtaacaaacatcaccagcctatcactaagggaagggcaagggcacagagagaaaccaccaatgtggtttaggagtgcaggcctacagaaagccaacggtggaacaggaattctaggagaaagcctctagcactctgggccatgcattaagcacaagatagtggtggtttgcactaaaggaatttgaagtctgtggtacacagaaggaacctagcaaccgaaaagcccaaaaccagctcagcaacagactagatttactcaacccttcccttcaaattgcctgatagaagaaaaaactgaaaacttccaggcataaattttagtcacctcgtctcagttttattcatctagtttcaatttcttccttttactaacaatgtctgacatttatctaaacattatggaacacataaagcaagtaaaaggacatatgctcaagaaagaaaagaaatgaagagaagcagacatggagacacctcagaggttgacagtcagacagggagcttaaaataacaatgactaatacgctgaaggaatcgggtagtggaaaaggtgaatccatgcatgaaaagatgggagatattcagaaggaaggaggaaagtttaaaaagaatcaaatggaaatgctgaaaataaaaacacaatatcagaaatgaagaattacttcaacaggcttttcagcagaatagtcagagaaatggaaagcagcaataacttgaagataattaaaacacaaagaggaaaaaaagagctaaaaggcaaacagaagcatggaagagttgcgaaaccagacaaaatcatttaatatacacatacttggaatctcaggaggagaagaaagaatgaagcagaagaaatatttgaagagataaaggccaagactttttcaaatataatgaaagataataaaccagagttcctgaagcttcagagaaacctaagcagcaggacaaatttattttaaagagatttcaattatatattaaagatatttacaaatattaaatctgttctatacacccacattgtaaattatattttaaaggcaattatattttaaagacatataaaaaactaaagtctgttatatttacccacattattactgtgtccaaatgcctttgtgtgtctatgcatgtgcatgagtgtgtctatgcatgtacatgagtgtgtctgtgtgttttccttcagaagttcatctgatatcatgctcagtttgccagatcttgctgtaacatctcttttcatgcaaattggctggcaataatttatctcagtttttgtcgtctgagaagcacattgctttcttatttgcaagatgttttcacagggcatcattgtaggtggtgagttgctgtttctgtgtttgctttccatatgtcaaataagcaactttattgtcttctgtctggcctcgtttcagaagccaagtctgctatttcatatctgcttcctggtagaaattgtttcttttctctttgattgacttcaagattttccctttacctttgttttcttaatcatttgaccgtgaagagctagagtttttcttcatatttatcctgaaactctgaaattagtatatcagataacacatctcatttattttttgaggccagcattgttctagcagcaaaacaagatactcttaaaaaaagattaatattaataatttaaaaaaatgagcaagtcaaatcagaaatgtattttaagaaaggaaaatatatcatgaacaaataagggattactatagaattcaaggtttggggcctggcgtagtggctcacacctgtaatcccagcactttgggaggctgaggccagtggatcacctgaggtcacgagttggagatcagcctggccaacatggtgaaaccctatctctactaaaaatacaaaaattagccaggcatggtggtgcatccctgtaatcccagctactcaggaggctaaggcaggagaaccaggaagcagaggttgcagtgagcccagatggcaatactgcactcaagccagaatgacagagtgagactccaactcaaaaaagaaaaaaaaaaaaaattcaagttttgtttactatttgaaatcaatcaaccagtaaatttctatactattactggactgaataagaaaagccataagattatttcattaaatgcagaaataacaattgacaaaattcaacatacctttaagataaaaataaactaagtaaagtagatacaaggatatatgggttatttatttattcctggtgaaatttgttacttcgttcttttaaagaatttgttcacttaatctatgtggtgaagtttttgacataaagctgttcaaaatattttcttatattctgttaaatttagaacaatatatatttatgcttcctcctgtcctttcatttctgatattagtaaaatgtgctaactcctgctgttagagatttaccaaatgtattgaattttgacaagaagcagttgttggtttcactagttttttctattggttttccaatttaattttattcatttattttcttgtctttattatttgtttccatttcttactttgggtttaatttgttcttcttttgttagtttattttagatagcattattgaggtataactgatatacaataaaatgtatatatttaatgtatacagtttatgagttttgacatagcatatgctcatgaaaccatcatcacaatcaatgtaatgcacatatccaccatttccaaaagtttcctatgtcccattgttttattgtttggttgtgggtttcctttttgtgataaaaacacttaacataaaatttgccctcaacaatttttcagtgcataatatagtattgttaactataactattattctatagtgcagatctctagaactaattcatcttgcataacaaaagccttatatcaattgaacaacaagtccacaactctctgtccccctgctccttggtaaccactattctactacctgtttttgagtttgactattttagatacctcatataagtgaaatcatgtagtatttatctttctgtgactagcttatttcacttagcataatgtccttcaaggtcatccatgttgtggcaaatggcagaatttcctttttttttaaggcttaataatattctactgtatgcaaaaaaaatcacaattgttttctatccattcatctttcaataggtatttcagttgcttccataatttagccattgtgagtgatgtaataaatacaggagtacaaatatcccttagagatccttatttcaattctttagagtatattcccagaagtaggattgctaaattatgtgatagttttattttcaattttttgaagaacctccctactgtgtcccatagcagctgcattattttactttctcaccaacagtgtaaaaaggttccaagtattataccttctcaccaaaattcaacttttgtttgtttggtggtatgaggtgatatctcacttcagtttgatttgtatttccttggttgtcagtgatgctgagcatctattcagataactgctgaccttttatttgtatgcctctatcagaaaaagtatctattcaggtttttgaccatattttaattaagtcatacttttttgctattgagttatagtagttccttgtatattttatatactaactccttatacatggcttgcaaatattttctctcattctgtaggtcacctctttactctgttgattgtttcctttcttgtgcagacaaccttttgtttcatatagtctcacttgtctatttttgcttttatttcttgtgcttttggtgtcatagccaggaatcattgtcaggaccaatgtcatggagatttctccctgtgttttctttcaggagttacacagtttcagatcttacatttaagtctttactccatttttagtttatttctgtgtacagtgtaagatagaaagcctatttcattattttgcttgttgacacccagttttcccaacacaatttgttaagaagactattttttctccattgtgtattattggtactctttcaaatatctgttaaccacatacgtgtcggtttaattcttggctctatattctgttcaattggtcttatataactgtctgtatgtcagtaccatagagttttaattactgtagttgtgtaatatattttgaaatcaggaagtatgataactctagctttattctttctactccagggtgctttggctattctgggtcttttgtggttccatatgaattttaaaattgttttctctatttctctaacaaatgccattgggattttgatggcaatagcatgaaatctacagattgctttgggtagaatgggcattttaacaatattaagtcttccaatccataaacatgggatatgttcccatttgtttgtgcctttaatctctttcattaatactttgttgttttctgtgtgtaagtctttcacttccttggttaagtttattcctaattgttttagtctttttgatgctatcataaatgagatagttttcctaattttctttgtggatagttcattgttactgcctaaaaatgttactgagttttttaggttaattctgtattctgcaactttactgaattcatttatcggctttaacagtttttggtggtctttatgattttctacatataaggtagtatgatattcatattatctccattattagttcattagctataactttaagtttcttagcagctgttctgaagattataataaacatttataacagtaccacaaagtattagagaaactatatgaaaatattctgctgtaaatttctttcattatatgtgaagtacaaaaacaacatttaaagattaatcatgataaagatacatactataaaccttattgctactgtgaagcaatagcaacacaggtactgtttagtcctacgaatgttatctagtttcctctatgcacacaaagaagtcatgagggcacacagccagatggtcatcacctacaagccaaaagaagaggccacagaatgaaacctaccttgccagcaccttaatcttggacttcccaccctacagaactgtaagaaataaatttttgttgtttaaaccacccatctatgatattttattatgggagactaatacaggtattaacagaaatcttcttaaacagatggaattacaatttacagaaaatctctccatgttacataaggctaaatatagatgaatgtaagaaccttccttatgtcatttgccaataactacagagaataatgttaaggaagaaaatactagtaaatgtaaaattagcaaaagatttttaaacattaaaataataaagaaagctatttaacagaagcataaagcagtgggcttcaagtttaggagcatgtaaataaaattggctacaggaattacatgtgtagtgttgctctaacattctgtatggtagtatagagaaagaaagtccattattagaatttaatgttgttgatgatttagaaggataagaatttatattgtatttatgtttcctacaatacttagcatagcattctgcatattttaactgctcgttagtatgttaattctatttaattttattcctttcgattacacaattacgcattgctttcaccttgtaatcttttttaaaaggcaaaacactgtattacaatatgagaatatggaacaataaaatgagaacacacttaagataacagaccttggatggattccactgtggagaatgtaagcaggtcatttcacctctttagagttctgtttcatcttcaggaaaacaacagggttggcagggtgatcctataatctcatgcatttattcattaaatgacactgttttttgagtacccattttattacaaacattaaattaggctcatataataaatctctggcttcatgaaactttatgaaactagctttatttagatttttttccttttttttttttttttttttttttgagaaagggtcttgctctgtcaccaaggctggacaggctacaatgcagtggtgtgatcacagctcacttcagtctcaatctcccaggatcaggccatcctatcgcctcagccctccagtagctgggactacagatggatgctactacactcagctattcttttctgtatttttttagacggggtttcaccttttgctcaggctggtcttgaactcctcagctcaagtgatccatctgccttggcctctcaaagtactgggattacaggcgtgagccatcattcctggccagaatttttagaattattatttcatcccattgcatcatcagaaaccttagcatcttgcaatacagtatatgttgggacaaaacgattatggtgtataggatactgtgaagcagaggctggaaagctgaaaatcacattatccagattcccttgaagctgagattctggatatgtttatgtttcaccaatcagatgcacaagagtgaaatctgaatttaaattgttttaagtacatagaaaggccaggtgtgagacctctattttgctggtgtgggtcacaacaaaacagagagggtatggaactttctgtagcagcagcttctcaattcaataatcagattcctgattatgatggaaagagaaaaacccttagagacacagttctgttatgtggttttccaagtgatttttggaagttctgcctaaaagtctgttatttcatttattccccaaattctgttagccatttagcacacatttataatttatttctcctagaattatctacagtagagtcagtactctgcaaccaaacactgactgacagaatcaactaatacaagagaacatatacttgggaataactgtataatagtccaagtcaaaagtttcctggctgatctgaaattattagtgaactgagagatgtttgcataagtgtttaagaataatggatttcttttcagtaggacttctgaacatttttaaatggttaatttatcttttaaatcacactatacagcatttcctccaatgtatttgaccaggaaattaactgttcatttcaggggaaatctattaacagctggagaaacacagagtttgtgaaacattggtctcatgtattgcccagcaatctgagccaacaacctttgcttttgttccaagtctatttgttccaagcaatttatttagacttttattttccatacatcttattgtcatgctatagtaagtgtttttctaaataggaatatcaatctccagccagttgaaaacagtatacattctttcattataagttgatgacattatttgcttgaacaaataaattccttttcagcctgcataaaattaaaaaaattagatgtaaaggcaaaaccagtttatttccagagctgacagaaatgaaagggaaaataatgagaagataaatagattttgtctttattttccagtttttttgtagatttaaatgagtttaatgggggtaagacttgtaaaagtcagaaggaactctgaatgtgtttgagatgagaaaatatttaactactagaaaatcttgggcactgagatcatccttagctatacaaaattaatgacatcattgtgtaatgtgctaagtactatcattttctagagtaaagagaggagtaattttagcttacaatggtaaggaaagcaatcgcagaagatgcgatgttaaagttccagtaggcttattacagctagagttgactagggtagaatagaatgtaaacaagatgattgagggtgggtcagtgtgattgcagacctggatataatttctacagatctaatgaattctgaaaagcataatcaagtctcactacttgactatgtatcataatgtaaatcaaatgcttagaaaagtgaaataaaatctgtgtcagtattatgattaattaccatgaataaacttagatgatattgttacaattacaaaattataaaattttagaattaaaaagaatttttgaaactatgttattcaaatcctatacccatctttccacctaaaatttaattcagttcaaaagaagaggggaaaaaatggtagctatattagactaagttggccacaataaaaaagttaaaaaaagataggctaaaaaatactcaaagaaataatggctaaaaatgtcccaaatgtggcaaaagacacaaacctacatatttaaaaagctgaacaaaccccaaagatgaacattgtataatagaggctgttgatgtcctgccaatattctctttgctacccactgccctgacccctccagttgctggaagtagcagtgttgtctaccacccacagtttctcccttctgtaaagaactgtccttggtcaatggcagcctcgttgctcaggaggtcagctaacctcactgtccatcccttggaccttggcaaaaaaaaaaaaaaacccaaaaaaaaaatgactgatggaggagtaccaaaggccactgccttactccaaggggatatttacactgtagcagacttttctccagagattctgtgaaattagaatgaagctagtctcaatctgagacaatattttgttagcttttttcccatgcccatcttgctgtctctactcacctcctcataagaatatggagaatagctagaactgtattaatgaagcagtaggatgctaactacaatagtcagggaagccctcctggggataaaatgcttaggcttccatatgaatgaaaaggaactagcaggagcaagttctctttctgttcaagaaaaaaacacagtgttgttgaaaaacagtgagtaagaggaaaagtgaaagaagttatgatcagagaggtggtcagaagccatatagaccacggtaggaaatatatatatatatgtaaaatatatgtatgtgtatatatatatgtgtatgtgtattatatgtgtatatatatacatatacacacacacatatatataatacatatatacctatacacgcacacatatatataacacacacacatatatatatatttaaaagtacattggctgctctgtgaggatggagtttagaaaagcaggagttgaagcacaaagaccagttaggatgctaatatgataatccaaatggcttggatgcacatagacatgctgcaaaaggaaagattcagaatatacttgagaggtacaaatgatgtcacttgctgctgcattgggcatgggaagtgagcagaagaaagcaatcaaaaacaactcctaagtttttggcttgagcaactgagcagataatggtatcttctactgagatgagggagtttatgggagaaatagatttgctgaaggtggatgagagttaacagttcttttttggaaatgataaatttgaaatgcctattgatattcaaagtgaaaatgtcatgaatttagttgtgtatgcaaggctggagctcacaaaagatgtccagatggaaatttggaagacatcagcatacaagtagtacttaaaaccctattactggaggatcttttctataggaaaaaatgtaagaaggcaacagaaagaatctgagactcaaccctaaagtacatcaacagttagacgttgaatacgataatttaagccagaaaaggagacagaatgaggtctcagtgaggcagaaaaagaaatgtgcggtgttaaggaaggcagaataaataaatgtttcaagaaagcaggagtgactgctggtcaagagttcttaataggctaagtcaatggtagagaagtaaccactatacttgttctcttgactagagctgattgagggtagtaatgggaacaaagaccagggtaggtgtatgttgaggagggagtgaggtgggtggcaggtggcggagagacagggagtcaaagaggtttatttgtgcttctttttatataactactagagagtctaaatgataaagcaaataatttaataaagagtaaaatagctgatgagagagacagaaacacacgaagattagaggattcgtgaaaatataaaagagtggaatcaagagctaaagaagagaaggggccttcaaagaaatagcatctcatctcccataacaaaaggaaaataataataatttctaaattatccttgctagtatgtaaaattaccatgcatttttgtatactggccttatcaatcttttttatttttatgtttcagtttgaataatttctatggacatcttccagtttactttttttctcagctgcatgcagtctgattataaatattcaatgttatttcccttatctttttttaatttctagcaattccacttgattatatttattgtttctatctctatgctgaaattcatctctttgtgcatgtcattctcctttttctttaggtcctttattatattaatcatagttatttaaatgttccagtcggagagtttcaactatagtttcagctatcagactcaactctgaatctgatttttcttgcttcttttttttttttttgtttgtttgtttgtttgttttttgagatggagtctcactctgtcacccaggctggagtacagtggtgctatattggctcactgcaagctccgcctcccaggttcacaccattctcttgcctcagcctcccgagtagctgggactacaggcacctgccaccacgcccggctaattttttgtattttttagtagagacggggtttcaccatgttagccaagatggtcttgatctccggacctcatgatccgcccgccttggcctcccagagtgctgggattcttgcttcttattcttgacaatggggtcattctttcttgcttttgtgggtacagaacataattgttactaaatactggtaattgtatgtggaaaaacagcagatacaaaagtaaatagtatttactcttggaaatgtgtgtacctctacttctgagttgagtcaatctagttagtagttagactagatttggtaattgtttttgctattgttacctgaagcgtaccacacacttccaattcctccagtgatagaatatgtacattgtgcttagagtggttccttgggtaccagaacgtttttttcagtattgctgatccatcccctgctttcagccattctctaccacagagagaatctcttaccatcctttgtcctggtcccagttggtagactattattgctggttactcagtttgaagctcttggagagaagatgagattcttggctctaatgacccagtctcagtcttaggcagatcctatacacccgggccttgaagctttggcttttcagcattcctgctccccttttccccctggatcctgcccatactccagttgtagcagacctctgctttgtatcagtccaggaacctgggcccaaaagttttctttcaaatttccaagaggtagagatattttaattctacccttctcccagaaggaatgggtctttttctgggtcctggagaaagaaggttttcctaccttttatgttatcactttcatataagcagaggacctttttctggcccttaatgttggaggggttgttgcctctttctcagtggcttagtaatttgttttatttgagacatgaatccagagaagtgagtggtaatttccaacttaccccagtggcaatcagtcactatctgctcatctgcacactggtgccaccaagggtcctgcatccagtcttctgcatgaacacctctggaagcctgtggaaaagaacatgtgagttaggatcaactccttttgtgtttaggttctcatggtcatgaataagctatcctacacattgctttaaagaatttggtaacattgtaactgatttttaacattgtacctgcttttaggacagcaatattttttcctcttatgttctgtcagaaatgaaatagttcttttgtcccatcccttttcagagtagtatgccattcattggaattcagttggtttgccttgcaatgtcagctctcttatgatttcaaaaaattttttatgattttgtagattttctaactttttctcattgttaagaagggaaagacattctcttgtcacattctacatcttaagcagaaatggacatcctcatctaccaattttagcatcagttggtaattcttgcctgaaaatcattgtgattaaggtcacacatttttctaatttcattatcatttccacatttattaactgacattcaaaagcttgcgctttgaaaaaatacaggtgaaaaacgactgtgggagtatccacgagtaataagggtaccccacactacatttcctgaattgtatgaactatgaaatattttccagaaaactctagtacgttttcttaattctgcctcttcatcaacatatagttaaaatccgcaatcattatttcaagctttactaactgcctaacatcgaattatggaccatgctaagttctatcgatacaaaagaaaatgatctattatctgttctcaaaaatagttaacctttactcaacacttaccatgtctcaggaacccttctaaatgattaataagtattgctttacttaatcctcacaacaatcctatgtgttgtgtacttattacttttttcatttatagtacatttaaccacagtagagattcataaaaattaggtagtctgtgagagacaaagttgagatacaaacccaggcaatctgattctagaaccaatgctactatgctcctctgcctttaagtgtggtggagttaaatgggcttgagatctcttctcagtcagatctgggttctaatcttgggaacagcgcttactatacgtgtggcatatggtcagtttctgttcatctctctttagtttgttttttttaatctgaaaaatggggaaaataataccaatgtcctcaagctagtctaacaataaagaaaagtacagaatgctaaagaaaatccagtactgtgtctgacatagtaactcaatccttagtttttgtttatttcctttttcatgaaggctgtcaatctggtgcaaataaaatatgtttcagtgtggcagtgctatgccaagagatgtacaaagtactctcctaatgcagaataattagttattctcaactggagaggaggttagagagaggttcacagggcaaatgagcctgcggtgtcataaaatgcatggcataacctgtgtacttgaaaaggaatgatagtaatcacaatttaatgccaacttccttttaatcttctgaaaatactcaactcacattagcagatgtagctactacacgagtcttcaagataatttttaaaagcactagacctttggaggagaaatatttttttccacaaacttgtgggttctgactctggactttgctctctgctgtctataacactgagaagtctttttttcacgtccaattgtgtagtcttaagaaactaatggatggcattcatgtccccttgaggtctttttttttttttttaatcttgcaaaacttctccaggtttctaaactaatcttcctattctgcaaagtttttttttttattccagagacattcactgtcattctagactataagagaggtgttggagatgtagtagtgagagttactaaattccctgctctgaaggcacgtgtagctagagagaagacagacaagagaagagatgttttctcagggtgctatggattacagactcttcttcctccaagcctccatctctagaaaaacaccagtaaaatatgagcaaccctcacatttcagtcacatttgacaatgtgcataacattcttggaaaataaaaaagaacagagcgacattacactgaaattatatctcctttatctggcactgagattattcttgcctctggtttagaaaaagctgcagaatcagaaaagcaaatgtgcctaatcctgcaaagaaaaagaacttggaggcaggagagagcaaagctagctggttcagagtcagtttcgatgagaatataaaccatttggtgcaatctgaacctgagactaacatatttcctgttctcatgatcaagtgaagtttcctctgttgagaaaatttcttttttatgtactcctatgattcagctgactgaatccttaaggaatcaatattaatcaattgggttctttaaccagtagctgtcagtgtaatttgaagagttcaatagaattacttcaatcatttttgctccatccacattatgttcgttcattctctttctctctctctctctttctttctttttttttttttttttttttttttacagagtcttgctctgttacccaggctggagggcagtggcacaatcttggctcactgcaacctctgcctcccaggttcaagcaattctcctgcctcagcctcccgagtagctgggatgacaggtttgtgccaccacacgtggctaattttttgtatttttagtagagatgggttttcaccatgttgaccaggcgggtcttgaactcctgacctcaagtgatctatcagcctcagcctttccaagtcctgagattacaggcatgagccaccatgcctggcccattcgcattattttcattttaaatttttttattttactgtacttaaagagagatgaaaacaccttggcatagaatttcctacgacaggttgtggtggagttggggaagaaattcttccccattttaaaaattctacacactgtatatcctttccaggtaaaaaaggggccactgatacatgatcaatagttttcctgttttgcacacttatgaccaaaggcccacatttataagatgcccagccaaggttagcagttcattctgtgaccatagattagggttttttctcaatgtacagcaaaggaacctctgcagacaccaaattttgaaaacactaagtccttactctccaagatcattattgaccaacccagagctctggacaacatagctatcttatcccaaaggtttgaaattaagagagatgtgagtccctcaatttgcccaaagaaaaataaagtttcatgtcagaaggaagatgtactgatgcttcaaggggaagataatgatagagtgagatctttcaatatttctttttaagtagactcaggagaaagaggttggtcccataacccagagacatacatgcctctctcagcctcagagctaaaggaggagactgtacttgtccttctgaattatgctaaccttgcacaagaaaatagtgtcatggcttccacaaaccatagatttctgaaggtactcagagggagagagctaggttaattttagaatttttatttaaaaactaatagaagtaaatgtctttgtcataatatgtgtgtggaggaaggggtagtagtagggaaacactgaagtactaggctacacgtctgtgctcttgatttccaactgtggttgcaagaattgtgtcgattttctcatgcttccttgtttgcaaagtttgcaaccttacatgctacacatggtattagcaccacactctaaccaactgagctaactggcctccaacaatacatgtgataaatgcacattcaacttctaactaaacaaacgtttgactgaatagtttcgctttttaaactctgtagacatttgatgccccctcttagttacttcatcagtgtcacacatgactcattaaaagccatttttattcaataaaaatatattaaatatgtacttggtacagggattctgccagacctcttttcaagaagggggtgtagagacaaatcaaatatgaattgcatatatagatatagatagtgagatagatggaaataaagtgacatggaaatgatagagaggaaagtgtcattgttgccaggtgagctggataagatagaacctcaggattagaattggctctggaaggatgggtaaaatttgaaactgagagatggaacattgcaaccagaaagaagagtctgagtaggaacatggtccatggggatcaggcataggtttgaagggaaatattgaaaataggtttcaggtccgggaatactgagcaaaaggccaggatttacgtaccactgagaattacagttatactcattattgaacaacttggctctataaaacatgctgactacttttctgggtttagttctctttgtctgaaattctttcccatcttcccacctccatcaccatccctggtcatttttttctacttaatttttgcccattatttggatatcagcctaaatattacttcctcaaggagatttctttaacccatatgatgaagtcagagctttttaaaataattattcacaatgccctatgattttcctgcagaacagatatgaaattttaattacatagtcttgtgtttaattattattttccctgctagatgataagcttcaggaaggcagaaataattttcatcttatttaattctatatcctcagtgtctagcaaactatctggtttataatgggtgttaaataagtatttctggaacaaatgacaaactaaatgaagatataaagataattagcagcatgatatgctaaaagtagggaagataaagactttagggttcccaaaagcacaggggtgagcaacgtcacagtactgttttcaaccagggtttagctgacagagaagtctttaaagtatgtgctatgccaagtcttgtaatatacatttgaggtggcaccactaatataaacaacaaaataatagctccatatatcaagggcttattggacgccaggttgccgggttatacatgcattacttcatgcagagatgaataagacatgataccagcaattcatcattaattgggaaaaatgataatgagtaatgcaaataattaactttaatttgattaactttaatttgatgtgtaaacattgtttctaagatagaagtaattactgagactttcagaaaacagagggcatgggagaaattaattttgcctatgggaatcaaggagggattcaaagaggtgacattaagctaggccttgagtacagcaggtagataaggacagaggggtgtaattaaaggcattagtgagaaaactgtgtgaaaaaagacatgaaagtttaaaagtgcttgtcaaagttcaggaaaaaatgagtaacgtgttgtgagaggaaagtgaatgggaagtagtgcaaaataaaggtggaaaaattaaactggggacagattgtgaaggtcttggcacaagaagctaaggagtttggacttgacagtattctgaaaacagtgtggagacttctaaagcttttttttttttttttttaagtaagagaaagacaaagtgagatcaaatttatagtttagaaagattgcttcctttgatccaagacctgagaaaagcttaaaagagatccctatcagcaaaaggctgcacttggttagcaactcctgtgggtctccgtacagaatgaataccacgtgatcttggcattgaaaggcagctgattctgcacctatcattcacccacacttccgcacaaacattgcaactacccttagcaacaccattccaaattgagattaaatgtagagtcatgtatcctctccctttcttatgttggtgtagtcaacattctaatgttcacaattgtttatgaaatattttgtctatttttctataaaattgtaaaatcttaaaagatagaatacaagttttgcataatttgaatcctggctaaggtctagtgagtgtaaaataagaaattaacatatttatatagattttttaatttcaagaagaaaatatgctttcagaatatacaagcaacacttcagtatataaacccaccctttggtgggtttgtctttatgaatagacaaatacacatgcacaaactttttatttttccctttggaaaattgatttaccatactatgtatactttgactatataattattttttcactcagactgtcatggatagcttttcaagtcagtattggaagatctaacatatacttttaaaaatatctgtacaaaatggcatagtatgaagatatgacaatttatttaacttcttttttattaatgattatttaaggtatttaattggtttcgaattattaattctcacaaattatgctgacattattatttgagttcttgaacactttcaagtattattgtactacaggttgccaatgtcagtactgctaagtcaaaatacgcacgctttttcaatacattttttcaaattattttctaaaaggggtatataagtttataccactataaaaggtttattgaactgcctattttctcaaaccagtgctgttcaacacagaagccactagccatatgtagctatttaaatttaaattttaaaaaattaaaaattcaatttttagtaacattggcaatatttatttatttatttccatataggatcttgccctgtcacccagactctgtagtgatgtggcgtgatcatggctcactgcagcctcaaactcctaggctcaagagatcctcccacctcagctttcagagtagctggagctacaggtgcctgctgccacacctagctaattttttttctttttcttttttttagagataaggtcactgtgttgcccaggctggtctcacactcctgaccttaagcagtcctcccacctgggcctcccaaaatgctaggattacagttgtgagccaccacacttagctggcaatattttaactgaccaatagctagctacatgtagtttttggtcaccataattaacaacacagatacagaaagttccatcatcacagaaagttctattgaacagtgctacctcaaattatggttaacattgggtgtcatgaatctttatgaatcttttacattttgggcaatataatttttttcttttttttctttttttttttttttttttagagacagagtcttgctgtgttgcttaggctggcttcaaactcctgagctcaagtgatcctcccacctcagcctctcaaataacggggactacaggatccaacactgcagcagcaatatgatacatttatcaaggcctcattttaattttccttcttattcaaactgtaagcattcttaaagtgtttattgattatttctattacttctcatgttaagtggctgttcatattctttcttcatgtttcataggattgcttgacatttattattaatatgcaagacaaatatttatcaactgactcaatgtatctatgaggtagcagagcaaaacacaatttaaataacattactgtgacattatttgacccataaaaagggtttgaacatataataagcaattgcttgcaaagaaatgcctcataataaattataaattatgtatctttttatcaaaacaattttccaaatattgtagattgtcaacacttgattaataaatttgagattattaattgaaaccaataaaactgcttttcttgataaagaattaaatacatctaattcatcttaaataagcccaactttattcctggttttccttatgtaggaaggctttactgaattgagagacagactgcattaggtcctaccatgtttgaaaaagtgctttacaataaagatgagattgtaaagccctctcccccaaaacataaaaaagggtacctctgtatgctgtagatgtaaaaatgtagaataaatcaaaatgtaaatgaggtttttcatgcttttagttttgatgattataatttaatgctaagaatttactagcagctggctggaagacagaaataatagcaatttcaatgtttctatagcacgttataattcccccaaaattttcatgcaaatcactctttgcgcaaaaataaatgaatgacaatgaagttgggagaaagcttgaaaacgcagagttggaaggttaaaggtttaggttacaggagtcagaaaagctttttttggaatcttagaagctttcttggtactggccaaagcttttcttggtactggccaaagtcaatgtaccacgaaagggaggtttgctcagattggccctgatggtgcacaacagaagcattgtcacccaggatgtcacttggcagcttggaaagtaatggggtctgaaggctagaaatagaccctgagaactggggcacaccccaaggaaatcgggggaaatgagaaatgagttaatgtctgagagtaattccaaatatggggattagaaagaatggaccacataacccaagatggaagatatacagtttttttgacttgtaaaataatgatgatgatgatgatgatgatgaatgatgatagccacctatgctaaataactgtatttaatcttcacaatgatttttttttttgaaaaacctaatgttcgctttgacaaaactggttcagagctgtaataagttgccaaagcctaatcacaagcagatccatgattctaactcaaatcttttaacttaaaattttatgcccacaacctctcctatctctggggaagtgaaatagcctgaggatctgtctctatctttaggcacaactgaaatgagtgacaagactgttctttaataaatgaatgtgtataggttgaacgccaaaattccagacattgcagggaagcagttttgaactctctttggtggattgtgtttgtgtaaggaacagaagcttctcttcaggggtgatcttatcactacacaatgtcaaagataaatgtattttcagcctctgcattaaactcaccttgccacctctttgtctttgtgctcctcacatcaagtgcctcagcagcctgtgattctgtgtttttataatctctctggtttcaaccaaaatggaaaaagtagtcttaggtatatatgaaggaagaagaacagcatgatctcacctaagaaggactgaggctatccagtaacgaaaatcaagaaaaacctgcaacagaggcctcaaccctgtattgcgggtggggtgggagtctcacagtgagatggcatcaccacttcatgttgcccaatacccttgctaagagtgtctcataggaagagtctctgatatgaacctaatattttattttctttgaattccctcagatataaatttgagataaggataggtatctgactggagttgtaggaagattaaatgtgatgattatgtaagcattaatcaagttcctgagttgaaggaggcactaataagaggagactttttgaagtgatggtgagtcatttcctccttacaaaatctttctgaattctcttttctcactggtaaaataaggatactagtactgtactgttactgtgacaattaaaagagatgcaaatgcaaagtgtttggcttataggaggtacacaagaagcagaaggtattaacatagctgtttcttcactagggtctgtctgtgtggtaagaggatttgtaggaaacatctctgggatcccatccctaattttcttcttagcatcctcaacgatttatgtgtagacactaacaactcactagattacagatccattaaaggggaaaggtgtacataccccaaatgcccaactataggggaataattatatatattttgagacttctctttgatggcatattcagtgtaatcattactaaattcagataataaaatactatgttacacaaaataatagtaggcataagttctatgtaacagcaatgtaaacaaatatatgtacacagataaagtctgttaactctgtaagagcagaggcattagtgtgggagtgtggctggggttggggagggtgtttgctctgtgagaccagggacgtgtgtgtgtataagagtgtgcttgcctatgcattgcagcattgcagttgtccagtaggatgcatggcacagatgtattagtcaaataatatatgaagtgggggaaaaggaacatagaaaaacaaaacagttctcttaaacagagtttaaattttgctttaaaatttttctgtgctgaatttacaatatgaaaagcaggcaataaaaattgtagcctcctagaatatcagagaaagttacatttggaacacagagttacaaacatggtaccttccctcctaccccacctcaaagcaaccattgttaagagttttctggttatctaagactttttaaaaatacatatacaaacataaaattacacacattctcttaccaggtaacttttgttgcacatcatgtattttggccatccttctatgtttgtatttaaagctcttattcttttcttgacaactccataaatattccatagtatgtgtttttgtttttgtttttgcttttgtttttgttttttgagatggagtcttgctctgttgcccaggctgtagtgcaatggcgcgatcttggctcactgcaacctctgcctcctgggttcaagcgattctcctgcctcagcttcccaagtagctgggattacaggtgtgcgccaccacgcctggctaatttttgtattcttagtagagatgggtttttgccatgctggccagactggtcttgaactcccaacctcaggcgatccacctgcctcagcctcctaaagtgctgggattacaggcgtgagccaccatgtctggccaatagtatgtgttttccttaattttcttaaccacttgcatattactcactatttatgattataagaatgctataattactttccttttttttttttaatagagttccgctcttgtggcccagactggagtataatggcaggatctcggctcactgcaacctccgcctcctgggttcaagctattctcctgcctcagcctcctgagtagctgggattacaggtctgcgccaccacacctggctaatttttgtattcttagtagagatgggtttttgccatgctggccagactggtcttgaactcccaacctcaggtgatccacccgcctcagcctcccaaagtgctgggattacaggcgtgagccaccgtgtccggccaatagtatgtgttttccttaattttcttaaccacttgcatattactcactatttatgattataagaatgctataattactttactattttttttttaatagagttccgctcttgtggtccaggctgcagtataatggcaggatctcggctcactgcaacctccgcctcctaggttcaagctattctcctgcctcagcctcccgagtagctgggattacagtcatgcgtcaccatgcctgactaatttttgtatttttagtagagacggggtttcaccatgttggccaggctggtcttgaactcctgatctcaggtgatacacccgcctcggcctcccaaagtgctgggattacaggcgtgagccactgcgcccgaactgtaattaaccttttatccatggaattgtagagtcaaagcatcacatgaacttaaaattttgatcaacattgacaaattcctcttcaggaaatgctatttctattattgtacccatcaatagtacagcaaagtgcctgttttcacacgtcttcatttaaactggatatggttaatctattacatttttatcaatcttataggtaaaattaatatatattttaatatgcatcttgaagtattgatcagaattattttatttcatttaaacgactaatttgtatctctggttcatttttctattgggtttttttcttttctttttttttcgagagggagtctccctctgtcccccaggctggagtgcagtgccgcgatctcggctcactgcaagctccgcctcccgggttcacaccattctcctgcctcagcctcccgagtggctgggactacaggcgcccgccaccacgcctggctaattttttgtatttttagtagagacggggtttcaccgtgttagccaggatggtctcgatctcctgacctcgtgatccgtccgcctccgcctcccaaagtgctaggattacaggcgtgagccaccgcgcccggccgggttttttctttattagtaaagaatacgtacttgttcaaaaggaagtctgaaatgcaatcactaaagacccacgttaaatttaattttttttttttccctgggagaagcaaatcatttaccgctagggagagtagaaaaaccctgactaggagcagaaagagtgagaattcaaagttgacaattattgctcgagctggctttgcccttcttccttgctcaaatgcagagaaggccttctgttcatgaaaacaggtatcttagccaaaaaccagagctgaacattagggctctcaattttccactggggagggcgggttctgcctgtgcttgagacacttcaccttataaaacaaaattagttgatccactcaacaggtaattgctagttaatgaggttacagcaggataaaacagatgtgctcagtaccgcttaatggtgaggagaaaaacaattctcctcctggtcttcagtagaggttgaaggataggggcaggtggatgaataggggtgaaggtaaatagggatgaatatacagactgatgcattttgagaaacttgtcagaatggggtgagaaagaagatacaggactggtgaacatgcttttgggttattgtttaacaaacataatggtaaaacattaaattattcttttactgggtaattttttgttactaattatttagcaaagttaataactgaaaaccattcctacattgtttttttcttatttggttaagttttttttcagtaaaacctcctttgatctcctcaccccattcgagagatactgaatttgcattcaatgagtatatacttctgatagcagtattactctatttagctatgttcacttgttagaaaaaaaaaaaagcaatagatgctttgtgctttccatgtttgaataagcccatttctgtctatttctaaaaatgtcaaatgtttttaaatgttttatggctacccatttaaaatacatttttaaatgtaaaactgtgatatcaggatatcaaaactaaaagaataaacatagtcaaattctctacttttaggaaaaagaaagcatgactcaaaagttttaaaatacttccccctgtgaaaacattctgttcctccctttcacacccttcatttgtacaagaaaagatgaagcaaaggagaaaaagaaatgaaaattaacattgagtttaggtggcatatgtattccaacagggcatatgagggttttatcagtagctacagaaaccacttcctcttttcagtgttagtttactaatcccttgaagcttgcgtgcaccttccactcctcaccttctgtagccactcacctcctctcacatcccacattacacttctatgtgctatgggatccatctaggcagtagttactcttatttcaaaacaaggatgttaaaaattactctactcatcaacaagtgaaagatcatgccttgcagctttgtgagctgtgcaaggtggcttagcttcttgactccgaagctttcctaaagtaacagatatttgcttactataaatgcttcttgagttgctacaggggtaatttgcaaagagaaagcagaggctcaggataatgctagatttttcatgtctgggtggataagaatctttccttttatgtttataaaattaaaaattgggtgcattcggtatatggcatactgacagagcatgggaactggacactgaccaaggtttgaatggtgacactgctatttacaagctgtggactctctacaagataagtaacttgcagattattatactatctcagggtttatgggaaatatatatatatatttgtatttttatatatatatttgtatattatatatatttgtatattatatatatttgtatatttatatatatatttgtatattatatataaatttgtatattatatatatttgtatattatatatatatttgtatattatatatatatatatttgtatattatatatatatatttgcatttttagtacagatggggtttcaccgtgttagccaggatggtctccatctcctgacctcaggtgatccacccacctcagcctcccaaagtgctgggattacaggcatgacccgctgcgcccagcctatgaggattatatttttaaggtaattcaaaatatctgaaatagcaggtgtttgataaaagcagttttctctcctttcttctgaaattcaaataaccaaatttcacatcgctggaattttggtgaatctttatacgggggaattatcatgcctgaatctcattcaaatacttttcacaattataaaatattctttcttgattattctaatccacattttactagcacagaaaaattaagtcaaagacttggtgagaaaaagtggttttccccaaatgaccagctagttaatggtagagtgtggcctgacatcagttttcacgactcagaggtaggaaatgccaaaagcagtctttcaaagctggtgtgcagtagtccttcccacattttcattttaaattattcaaacaaaaattgtttatcaatgacaacttccattttccccaacttggtagtactacctttatagttagttgctaaataacatatattttgattaaatagctctgaattatcttatataacttgtattttattaatcgcaacagggtctattaatatgcacatatgagaaagtcatgcatgaatagaagacatactactgattaatatgtgtctttgatgcattttgcttcctccactccataaatcaacttcacatggtctgaatttggaaaacccggatataaagttcttccttgtttattgttttctgcttgctactcttttcttctcaaaagaactatgaatttcttgaaggttgggagagcagattcttagaaaaaatatgaagaggatgaaggttttttatttttctatgtttctcctttccttttttcttaatctctggaaacctcccacacttcagggcccagggccctcctactgtgatgttctctctgggctttgtataaattcaaatcttttaccactttttctagtatccctaagggatttttgtgggaaaaataatcttagctaactttgatgacgcgtattttgttacagttctcagaagtgtttgtattttaaccacaggcaattacattcaataaatatttattgaagcctattctaaacctgaatagtgtcaattacaggaccttcctgccatgcccaccacctataaagatgctaaggaaggcagacaaataaataaattaaatgaagcatgcagtcaatatggtgatgaaagcaggtacgctgtgtagctgttgtacagaagaaggaatgactaagcattcttggtataacagggagggctttctcaatgacccaaaggaattcatcataaaagtgaaatttcagacatcagtgataaactagtagaaaaattgctacccctaagctaaatttcactgttttgtcacattgaaactttatgcaaacaaaatagaaactttcatgtctctttgccaaatttttccctctgctaagtcaccctacctaagtcagtttctctttttctgtctctctctgtctctctttcatcttctccttctctctcttgctcactagctctagttctcactcttgctcttactctaaaagcaaaacatctgcaccatcacagactagctataacctctcctcctcagattcaaatctcttccttgcctttagaagaattaatggttcccttcttcatgctctcctcacactgtatttaaaactcacagcctttatcatattctgcgtattaaagtcactaccactcagtttagtagtaataaacctttacatttctattataaatcttacagtttacaaaatagtttcacatatatcatcacatgtgatcctgacaacagctctttaaggtgagaattatctttgggtttttttttttgttttttttttgttttttttttgagacggagtctcactctgtcccccaggctggagtgcagtggcgccatctcggctcattgcaagctccgcctctcaggttcaagccattctcttgcctcagcctcccgaatagctgggactacaagggcccgccaccacgcccggctaaattttttgtatttttagtagagacggggtttcaccgtgttagccaggatggtctggatctcctgacctcgtgatctgcccatctcggcctcccaaagtgctgggattacaggcgtgagccaccgctcccagccaagaattatctttgttttattatgagaatatctaaacctcagagaatttacgcaagataatacatttagtaagcagctgccaaagttaggtcttctaacgctaaagttatttctctaatgtaattttgagacaatattctttgcataacatcttacaaattgaggacatcatactggatttgaatggagaaaataagctacatattcttgaactttatagtttccttgcctcttatgtttaactatccagtaatttttatcacacttttttaacatttatcttcaaaactgcaagttctgtttttgttccagaaatattctgtggaattaacatgtgcatagagtcaaactacttgaactttattttaaaatatatttataaaggtctttctgcgcataatgtattggatcacttgactcaagtaattaaactatatactgttaatattatgactgggaaatttcctttaaattaagtaatttcaattattcattcaattgtaggtttgggtttttgcccctgctacatggaataactaaatcatataatttaaagtagattcaagtttagacagagtatgtcttgagctgtcatttaatggaaacggctcagagaagttgctacatctaactagtgtcagaaactttcctaggttagctaacatttatgaggcaggaagaaactcaagtcactacgtagccaactttctgtttttcccaccataatgaatgtcatgtgctcataatagtaaccctttctaaaacattaaaaaatatttacagtaaaaaaaaaatttaaaagttaaaaaaaataggactttggagaggcatttctccatggcatttctatagatcttgtgttaggctgttttttcaaggttgttcccatagcaaagagcttcttggaagctagaaatggtctctccttacaggtcagaggacagatttatttgctgaccaggatatcaaagatgagatgtttccatctccttcctggagacaatccggcataatcaagatattgtcttttccagaggagaggtggagaggtttgccagaaatccctgtataaaattaggatatcctcatctgagagttcctcaattgtgacagagattcatggagtgattattatttacctgggcccatgtctgccttgtcctctccttctttcttttaatattattaaataaatattttctattattatgaactccatgtacagatttttattagctataaatatttcctcatttacacaaactgtaattttttgcccacacctatataattttctgtttttctctactacaaatatacattaataaacatcattgttcttaattttgtctgtgtattatattatttttaataggatagctgtgcagatgtgaaattatctaataaaatgctaaaaagattatttgagattcttatttcattttaccaaaatgctttccaaaatgttcaaaccatgttgtattctcactagccatgtcacaatgtgttttcataactataatctttcacctcttctccaccactcatggttttagctattctggattattcacacttcctcaaatttctatagaccttttcaacatgttctttccttgactttaaatgctgttggcatacacaacgcttacccagcagagctcagcctatcactttctcagagagttctctgacttcgtaaactaccatacattatcattatgatactgacacttacctttgtgatactcaacccacatgtacctgaagttttatttctggcttaaatttaagctccatgacagcaagggtctcatttgccatgttcattgctgactccttgctgctaacacagcttagcatggagtaagtaaatatgcacttgtatgaatgaatgaatctttattgaaaaagtgaatttttttcaatgttcataaaaatctagtgagataggcatggcaattatccctaatttgacctgtaatgaatcacagaaatagtttgatcttctcaacatccaaatgagttggtgagagagatataattataagccaggtttcttggctcctagcagatactttttccaatatatgtttcagatattttgagtatttctgtgatttaaaatgacagttttgtgcaaattgagttctagggagaatcatagagattctctaaatatttattgtctctatgtctatagagatacctaataatacccctgaatcaatagtttttctattaatggattcaatttaacaaaatcagaaattataatcacagagggaacagtttgttttttcagccttctagggaaccatgttaaacttagttcagcaaattagatgatagtttcattttgactttcagacatgtcatgtgaatcacacgcagatgggtttttcttaattaactcttgcaattatgcaacagattttttgcctacagcttttcaattttctaaagaaaaaccaagaaagacagtccagcacgggacactaatctttatttattcctcctcattccaggttctaagcaactagaaagttcaacttgtggtaatgtttctgtacccttttatgagagaaaaatgataagctgacatttaaaatgtttaaaaagcatctcagtatatgacacattgtggtataacggtataatgaaaactatcaggtttaacatgctgctcagtctgtagcacagaaccacatgctcatagtaatgtgcatcaggagtggccacactgcagtttcagggggccctaagttctctagaaagttgggggctgttgactctagatttctgatcagtgtcccaataagctgggaatatttgccaggagcccaacaaatgggacaccaatttgacatatggtcctgaagatagaagccaaagttcgctatgacttagggatggctgaagtaaaaattcattcatcaaatattagactcaaaacttccttgctttcatcatatcattctttcttacttggtcctttttctgcatatcttaatttctcttttatgaaccccttttcttaaacatttttgttaaattttattttaaactatcttcagccctttctttcccctttttcccctgcatgacatagcctttctttgggtgatctctatgcttgtaacgtcagctctcctttatttagtgatgactaataaaaactgtgttagccagcgcctgaggtaacctgaacaccttgtaagtattctcattgtctgcctattccttgaagagagtagatgctcaataaatatttattgcaagattgaatgaccattcccgagtcctacatcaatattcccagccttttactagacaactccattattatatcccacaggtgcttcaaagacatatccccatttgaatgaacttttttccaaaaatatctactctcctgtcatttcctcttgcttagtagctgcaacacttaccagtaggtactccatgttgaatagatatttattgaataaatacagtttttaagatttaaaaagtattatatttattatattatatatggatgaccatttattcagtataaccagaatttctttttagtctgtatacaagtaaggcagtgtggtacactgggaagaaataagtatctaacttttcataaattgaaaatcaaccaagctttctagtttagctacttattaactgcatgtttattgagatgcttaatgtctttgtttgtaacactttttcatttccaaaatgaagtaaataatgcctgccttatagtgcacctgtaaggattagacagtgtgaatatgtacaaattgtctatagataatagacacttaataaacagtaactgttattataaaaatgaggttgggcatggtggctcacacctgtaatcacagcactttgggaggctgaggcagggggatcacaaggtcaggagttcaagaccagcctgaccaacgtggtgaaacatctctactaaaaatacaaaaattagctgggcattgtggcgtgtgcctgtaatcccagctactcaggaggctgaggcagaagaatcacttgaatctgggaggtggaagttgcagtgagccgagatcgtgccaccgcactccagcctgggtgatagagcgagactcaccatctcaaaaaaacaaacaaacaaaaaaatgaattatacccatacctgcagcctctctccaagcacttacctttaacttaatttctttgttccttctagtttattaataatactgttgtcagtaatttgtaccctacatcagtgagaaggcctattaacattatagaagtcaaaaaaggaaaaaaaattacaaattaaaaacataaggcacctaataacagtatgaatttgcattcctagaattctctccttgtaaattcaatcttaactagatgctagaatgagataaaacccagcactggcaagctgacaagtgtttgagagaacatttgtggctgaaggcttaggcagaatttccagaggagagggctatagtgcaacacttatgaataggcaaaaagcataagttacaaacaagatataatgtacatacatggatgtgtaccaaatagcatagcaactaaatctattaagaacaaataattaaaataactgaaaaattagagtgaatttacattgaaagatttcaattactctttcagaattgaaagttgtaatagacaaaagaaaaaaaagcaagttcataaagagatttaatacaatcacagtgagtgtatatcacaggcctgttgagcagtaaaatataattttttatatgttcatttcataaaattcgccacaaagaaagcattaataaaatcttaaatattggcattttataggccacattctccaaactaactactaaaataagaaaataaattataataaaaattgaacttgttataataagaaactgactccttaataacctatagaacaagctagaaatcaaacctaaattataaactttttaatacaaaggaaaagaagcactttataacttgcgggatgcaagtttgtcttagaagaaaacttagagcctaatatgtctttattatttaaggaaaagattgaaaatgaggtactaagtactatgttaataaattagaatagaaaaaacaaactgagacaaagtaggaagaaaaaattagaactaataaaagatgaaattaataaattaaaaataaacaaaatatcagggtagatgagatgtttttttaaaaaaattatatccaaatttagatccatcaaatgcttcattaaacaaaaatatacaattttgtaagtaataaaaaatcttgaaacaaaaactgtgattctaaaatttacagggaggggaaaaaatgccagagaaaagctgagaaatatataaaaaagaatagtgacagaacttgctttaaagctaattactgaaacaaaacagcaaaatactccagaatttgttattgaaatttagagggaaaataatatttgtttatttattttttgttatttatttatttatttagagacggagtcttgccctgtcccccacccaggctggagtacagtggtgcaatctcggcccactgcaagctccgcttcctgggttcacgccatcctcctgcctcagcctcctgagtagctgggactacaggcgcccgccaccacgcctggctaattttttgtatttttagtagagacggggtttcaccatgttagccaggatggtctcgatctgctgacctcgtgatcctcacacctcagcctcccaaagtgctgggattacaggcatgagccaccgtgctcagctggaaaataatatttatttattaaatggttctggtaccactgactagatgaaaagacaacttaacttatatatcacaccatatagaaaactaggttttaggtgtttcagagagacaatattaaaattaaaaaacaattatttgaaatatttcaacaattcgaaatatttaaattaaaaaaatgtttaaagcaactcagaagagaatggaagtgtttgaggaaagggccaggtgggacgtgaaaggactgacattcctggtggaaatgtgattagctaagtctgttctggacatttaatctagcaatgtccattgatctagcaattagttcccatcacattcctatagaaacaaaagtatctgtaggaaggatatatgttcaaaaattttaattgcaacattgtttgcattggcaaaaaaatgataatgctgaaatacctggaaataatccaaatgtccattgataagaaaaccgttaaatagatgtgttacagaccttaaatcccattcagctattttctataaatgaattcaatttcttgatgtcaagagatatctctaatgtatttttaagaatggaagaattttaagaatgaaatcaggttaaggagaattaatgaaagaaagaaaatttggttgaggagaaatgtatatagtatgttcccttttcatgaaaataaaaagccacaaaaatccatacatagatgcatcaaaataataataatagcgcctttacagtgcttattctatgacactattgttctaagcacttcacataataatttatttaaaacttcattataaccctatgagataagtactcttattatcttggttttacagatggggaaaccaagtcacagaagataagtaagtttcctaaagtcacacaggtagggtcagtgccaagattcaaaccatgcattctggttccagaatctgtgcccttaagtaatatgtcccctacttctcacgcatatttgtaaatggctaggtgagtttaataaaagagggaaggatacacaccagggagtgaacatacgttaccttgcttgtcagggtgtgtatggcaagaaaaaggggggaaaggaaagttaaggaaaagaacaatgacaattacagcacaatggcaaaatgcacttggtgtaatgttaagtaaaatttagagaattttatgtctccatcatacaatataaatataaatataattaagtagaagaaacaaagacaagaaaggagtaggcaccaatgaaaatgaggtcttttattcttcagagttctgttaccttagtctttagtatctgcagcaaagttatttattcacattcttcctatttttatatctagctagctagctagctatccatctgaagggcgttgtgtttaaagtgaaaggagaagccagttgcaatagtttacacttataatccctgtgttttgagaggctgaggtgggagggttgcttgaggccaagagctggaggctgcagtggactatgccactgcactccaacctaggcaacagaatgagactgtctctaataaaaataaaaaataaagtggaaaagtcatgtattaatgagcctgatttctgcaactgattatgcaaatacaatattttaaatatccgcctgtcattacttgggtaagttatctgattcttggaaaagaaatgaaatctctcaactgggagaaactgatagttttgacctttaaacctgccatccttagaccagctgctggcctggctttgctctcttcatgccaagactctctacagttttgcttgtttaaaatttgctttgtttgacttcatgtttccctctaagcaatagcctataaggagaagaggagtcaagtcacactgcaaaactgtgaagataaaccctttgacgtagggtttaacatcctattgcccaacacatgtttataacttgaattgaagttagcaagctaaatatatgtaaagtcatccagggtcaactttcacagcttccaaactaatccacactagcatgttgatgtaacatccctgatgctactagggctcaccagatcccttgtgctggataaatatctctgaaaatgaagtccttgtgctagatgaatatctccaaaggtgaacagtatgaggtaagaaatataacttggctcggcacagtgcctcacgcctgtaatcccagcactttgggtggccgaggtgggtggatcacttgaggtcaggagtttgagaccagcctggtcaacacggcaaaaccccatctctactaaaaatacaaaaattagccaggcatggtggtgggcgcctgtagttccagctacccaggaggctgaggcaggagaatggcttgaatccgggaggcagacgctacaactgagatcacactactgcactccagcctgggtgatagagcgagactgtttcaaaaaaaaaaaaaagaagaaatataaaatttataatcatctattgacacaaacgcttggcaaagaaaaatttgctcccaataaacctgactcttttgttgttgttgttgttaaagttaaacctggagagtaagtagtttccatcaacattaaataaatattattgagcacctattatgtgctagggatataacagtgaataagacagacaaggctcaagctgcgtagagtttatattccagtgaagcagatacataatacacaagaaattccaacaattacaggcaattttaagtgttacctggaaataaatagcgtgatgaaaaataaaaatgaacttaagctcctcaacagactgaatggaccctttcttggccaagggtatcccagagaaaccttgaaaactgagttaccagccacagtgggatgggaagttggacatgcctcgttaagcccccttgcttcctaaccaccattaaactttctttcctaagggttaaagcaagcttgtccaactcacagcccatgggccacatgcagcacaggacggctttgaatacggcccaacacaaatttgtaaactttcttaaaacattatgagatttaagttttgtgtgtgtctttctctctctttctttttctttctttccttccctttctttctttctttctttctttctttctttctttctttctttctttctttctttctttctcatcagccgttgttagtgttagtgtatttctttttttttttttttttgaggcagagtcttgctctgtcgcccagactggaatgcatccaagtagctgggactacaggcacccaccaatacacccagctaattttttgtattttttagtagagacagggtttcaccatcttaggcaggatggtctcgatctcctgacctcgtgatccgcccgcctcggcctcccaaagtgctgggattacaggcatgagccaccgcacccggccagtgttagtgtatttcatgcatagccaaagacaattcttctcccaatgtggcccagtgaagccaaaagattggataaccctgagttaaacagaaaccagccctttggaaatacttgctccatcagtagtatcaaccaatgcctgatgctgcccctttgttttgctgtttcaacaagacagccaaccagcattccttcctgatgagagaccaccgaccatggagtggttctggaagtctacaggaagatgagtagtgagggtttttgtgtcctctgcttcaccttttgatatgagaaggccaaaaactccaccctcagatggtgataatgccccattttttgcacatgggtcccacagagaggcatggagcaaaattgcacatgcacgtatttctcctttcatgaatattcatgactcctcctatagcttattgaatatgtatatttgtccacctcattcagtataaatccctgtcttatacttttcactctcaaaatatctgtttctggcttctggccagaggctacacttcgtggcctgtcagaatggccaccctgcaggctgcaaccctttataagaaacaaagctctcttttctgtattaactttctcatttttcagttgacagtgataaaagtgaatagctggaaaaggccaccatagatattatggttagtggaggcctttctgagaaggtaaaatatttatcagtgagaatttcacaaacagtgagaatgagcagttttttgaaaaatgatgtgaattatttcaggcagagaaaaatagcaaagtgaaaaggtaatgaagagggaagtctagagggtttgaggatcaaagagaaagcaggttcctgggagagtgaacaactagaggatcaaagggatagatggggccaatgatgcagggtcttgtgggattttattcaaacatgataaaaaggtagcctactgaggagtattaagcaagggaattaatgattcacatttaaattaaaaaaagcaaagtggtgatggtagactcagtcggactcactgatcagatacggggtgggagacaggagagggaagagccaaggaaggcgcttaggttcctggcttgtgcattgaattcaatgaaaagaaaatgaaattagaaagtaattgctatagtccagcaagaaattatggcatattggaccagagtggtattggtggaaacagatcaaagtggacacattcatgaagtttgtccttgtctcttcagcgttgctcttactggtgtggtctatgggatactcctcatctattagcaaacaataaggcttctgaaaattttcatttcaaaaacttggtttatttaacagaaatagtgaagtgagaatgggatcacacagtagagactatctcagtaattcacagttccacaggtgactcaacatgcatcatgtggatagttcatttgtaaaatctttgtttttcttgatttcatatttgtctgcatcaatgattagacaaaatctcattctcttaactccactctaacaattggacttaaagccagaagtcttgttgattatcagctttgtattcaccagttgtatttttattaaaaagtcatttatcgcttctgagcctcagtttccttatttgtaaaatgggagtaataatatctggaagatgactctcaggttgacataaaatgtgaatgtactatgcagctgataataagctattcaaatacaaagcataatgattatttttctaatgttataaactcttattccatcacattaaaaaatgttcccctattattttttacatatcttaactgaataaacctagaatattcagatgcctgatatacaaaagtaacactagtgagccacaatttgtaagggctatgctttctgtggtttctccattcttgcagttgtgtcgtagtcatccaaccacattctctgcccatccctctttgccttatgacaaagggcacatatttttgagatagctgtcagtgagagatctcacagtggaaaattattacagtgaagaggttttcagagtgtgctccaaggacctatggggatccttgcaggagttctctacgttcctcattttcaattatatatctgtataatgctggttttttcatattcttcaactaaagcaatatatttcaataggtggaatgcagaagtagataagatagcactctttcattaagccagatattaaagattttgcaaatctataagataatgttgcttttcccattaatttttgtttgtttgttttggaactacagctatatcttcaagagtgttactttcattttttattgttaaatgaataagtcaatattctatttttttacatttcatttcgaatagggtaaatgttatcagatattgaccatataagcaaaagctctttgggttctgtatatcgtttaagaatgcaaaggagtcctgagagcaaaactttgagaaacattggtattgtgcaatcaaccaagctgggcagcattaccaaagcaaacctgttatttcttttcatccaccataatagtaaggcctaattagctgagttttcttgcacagaaatttcattattctctccttctgccttccttcctgcttagcttcatatcttttttcctttcttttacacattttattgagtgaataaatgaataaacattgaccaggttctgtgatgaaccttgatgtatgaaaataatatattcctgctgtcaaggagcatggagccttatggaaaagacagtcattcactcagataattataatgaattatgaatgcaggagcatggggtcataggaaagagagttttgacatctgcctagaagatcaggaggacagaaacagagtacagtacccaggacatcataaggcctgaacaaacggtccagcctcctttttatggtttaaatcaacccataatttcaaacagaagtttccccactgtggctgccatgatggcgctctgctcccatttctcttccagagagcacctgtcataggggtgtcctttgctgacagcttccagccatcacggcttcaggattcacctcagcttttcaatcaaggccaactgctaagtgcagcacaggtatcaagcctgaccatttgggcttaagccaagctcccttatgggcagtctttgcaccagagttccctgctaggctggccgaggctatctcagaggtgtatctctaagtcttttttgccccagtcccctttccttccttctttagcaggtgtcagagaactaccttgtcatctgagagtttctcttcttattcctgttccttccctcttttttctttcacaggcattgctctctaatagattatttgagcctcagtttgatcagagataaaatagaaatcaggtaatactttcttcatacaattgtgagatgattaaatgggataacattaatatatgtttgttattttggtaaaatgtaaagtggtaaataaaattattatgatcattatcattactactaattacagaggtatatacaatagcaaacaacatagtataatattaatatatcaaattcttcctctaagatctttcttagttttgatatgtattctagcatagtttttccaatttattcatgaggcagagaacatagaaatcatactgctctttgccaaatattatgaattatagacaaatttacatcaatcataatgttcatttactcaacaaatatttgaacatttattttgtgctaggagttattcagattgctaggattacattgaactggatttggaatctactgtctaattaataaggaaaattttccaatagaaatacacacagtaatacatgtatgtagtcagatctccacagagatctgtattatcttatttagtcttctcgaagccaggtgaggtagtagtcattgggaatataattccaaacattttacaggtgagaaaaccaaggcacaaaaagaagtaaaataactttctcaaaattaaacagctgctgagtgtcagaaccagacttcaaatagagatagtctggctggagtccttgccattaatatgtaagccagtgattctcaaattttagtttatatcaggaacctctcaaaggtaattgttaaaacacaaattgctgggatttacccagacattttcttatttggtagatatgggactcaggaatttgaatttctaacaaattccaagggcatgctactgtggtttgaatatagctgtccactaaaatttatgtgtcaaattcatgtgttagaaatttggttactaatgcaacagtgttgagaggtggggcctttcagaggtgattgggtcataagagctctgccttcattaatggattaatccaatcatagattaatggattatgggctatgaaggaagtgagttagttatcatgaaagtgaatgtgttataaaagccagtttctccatttctcgtgagcttcctcaccgtgtgatggcttgcaccacctctagactctggagagtcgccaccagcaaggagaccctcaacagttgtggccccctgaccatgaacttcctagcctccagaactgtaagaagtaaaagtcttttctttataattacccagtcttagttattcagttataacaacagaaaatcaactaacacagaaaattggtacaaaggagtagggctgttgctaatagtgaatacctgaaaatataaacatggctttgaaactgggtaatgaacagtctggaagaatttggatgagcacgctagaaaaagcttgtatcactgtgaatggagcattaaggctgattctggtgagggtttagtaaaacaaaaagctagagaaagtctgaaactccttagagatcatttaagtggtcatgatcagaatgctgatagaaatatgaatagaaaagaccattccgatgaggtcccagatggaaatgaggaacaaggtattggaaactggagtaaaggccatcgctgctataaactggctaagaccttggctaaattctgtccatgtcctaggactttatgaaatgcagaacttaacagtgataaactaggatatctggtggaaggaatatctaagcagcaaagtatttaggctactaaatggcttcttttaactacttatagtaagatataagaaaaaacagaatagaaaaaaattagaaaatttgaagcctggccaccttaacagtgaaaggggtgtttgggtatggtcaagagattgctaaagaggtcaccatggatagaatgaagccaaaggctatccatgacaatgaaattaaaaaccccagaggcatttctgggatctttgaggctgccccttcctcataggccctgagctctaagagggcagaataattccggggatggactgctgcccagggctgctttgggtctctactccctgcgttccagcacactgctcctcagcgcccccagctgtggttcaagcagccacaggtgcagattaacctgcagctctaggatgtacaagtggtaaaccatggcagtatccatgtggtactaattctgcaggtgcatagaatgcaagagctgtggaggcctggcagcctccacctagattttgaagaatgtgttggactgtctgagggtagagctactgcagagagcttccactagggcaatacgaagtggaacagtggaactggggttgttgcatagagcccccctaagggcaatgcctaatgcagctgtaagagccagactgccaccaggaccccagaacagtagagccaccagcagcatgcaatacctgcctgggaaagctgagggcaccagggtgccttgaggcctcctgaaataccccatcccccaatgtgcacaagatgctgtacatggaatcaagaaagattattctccagccttaaaatttaagtcttctctgctgagtttttgacttgcttgggcctgttacttctttcttctggcctgtttgtctcttttggaaagggagtgtataccttatacctgtcccaccattgtatctaggaagtagataacttgttttgatttcacaaactcccagatgacactttagacttttgagttggtgctggaacaaattcagtcttttgggactactaggatggaatgactgtattttgaattgtgagaaggccatgaattctgggggtcagggacagaatgctgtggtttgaacataggttgtcccccaaaagtcatgtgtcgagaggtgggacctttgagaagtgattggcagtgccctcatgaatggatgaatctatcatgggttaatagattaatggattatggaattatcaaggattagttatcatgagggtgggtctgtaataagcactagtttggccatctctcatgaccccctttgccacgtgataccctgtactaccttgggattctgcaaagagtctcaaccagcaagaagggcccccttcgatggggcctcttgaccttggacttacctgtctctagaactataaaaaataattttctttgttttaaattaccgagtctcaggtacagttctagcaacagaaaacagactaagacagatgctgatgtccctggtcctaggctacactttgagaaccactgccaagtaatgctgcctctctgtaaacctgcttttaatgatgggagcctactgacagaccatgttttgcacataagctcacttttgttttatataattttaacatatactgaatttttgggaatgcaacctcttgataaaccttcaacagaaaattctactttgttctcctgggaatttgaccaagaattgtccaacatcaacaactttggtatggtgtttgagtgattaattgataaggtatttgagttataactcatcagaaatcatttgtgctctcagaaaaaagttcctatcacatttaccacgattctacaattttacatagaagtgaaaccacctttgcaaaaattacaactgtgaaagaaatcagacctaatcgactccatcttgcttctaatctttaagctgtcctttttcattcctgggcataggtggaacaaactttgggaagtaattcagttcatggtttgactctgaaacaaaattgataatagccctttcccaaaaagactcccttcttgcctggggaccagtctgccttcgcaggactaacaaattagctacaagattagaaattacagtttaggggtcatgtggcctctggctccaagagtctgcaccctcccaccctccaagttgcttctggggataacatctctattgtaaaatctaagatcagtgcttgagatattttacagaccctgcactccatagatcagctgacaccactgagaccagcaatctggctcaaccatatctgccatcccacccaggaacagaagatagcaagaaaaactcacttagaccccctatgattccatctccaacctaaccaatcagcactccccacttcccaagcccctacccaccaaattatctttgaaaactctgatccctgaatgctcggggagactgatttgagtgataataaaactcccgtctcccccacagccggctctgtatgaattactcttcctccattgcaattcccctgtcttgataaattggctctgtctaggcagcaggccaggtgaatccattgggtggttacagaagtgtgaagagcaagtatctgagtgcctcattatgttttccaacacagtcatacttgaacattttacatgatgggatataacttattatactagaaatatatttaaaatatctgatttcttctttatattacatttggcattacatttctttttattaagtgtgtaagcagtttatatattaatttcatttcagaaagtaaaggatttggggtctgatcagtttgagaatcaattttttgtgtgtgcgtggaatggagagttagtagttatttttgagagagaacagtatgggaattattagattagtagaaataaactaaactgaaaatcaatgtgcctgaggttcattcttaaatcttactaagtggcaatatgacattcagcaagtgatttaactctctgaatctccatttcccaattttaaaatgaatccattagactaagaggtccacaagatctttttctattattcaatcattgaataaagactgttttaaactttctttacaattaagtgtgttgctttgattacattcatcaaagaaatttccacctaaactggctcttcaatattgatgacctaatacaaatttaatgttttaacaatcagtaacacaccttcctagagattcaggaagggaagcttaatctgtcagggtatctttaaataaatagtgtgttagcttaattatacaatgtcagctttcaattctaagaaggtatataaaacctaaaagcaaggtgttccccaaccccccgccaccaaccccgccccaggctttggaaatttgtgcccccattgaagagtattttcacctctgaactttcaaggacaactccttttgcctcattgaaactggctttcaagcttggcaaccaagataagaatattaagtacacttattttaacactcaaggacactttctgaataaaccagaatctagggagatataagtgaataatttggacctgctctctttgaatgtttataatctggtggaaaaaaaatggacatatgaatattgatttgtgaccagtgcaaagggggcaaaaattcatatcccaaagaaaacggggacacatcaggtctgtcttgttcatcactgtgtccacagggcctgacacctagtaggctcagtgggagaaaggagccccaattaccaacaaaagccaggaaagaacgggaggctcttacggaaaagggtgatacttaaactgagcaaggaggcacctggaaatagtgccacctaataatttttggcgatcagactggcacactagaacggttcataagaccagccttctcccattggctagcttccttcctcacccttctcaccctgggcaagccgcttcctctctctgggcctcttgcttttcctctgtaacataaaaggggttgagcaatatcatctctgagagcgccatgtgtgtgcgtgccagagggaaaacccccacaacgctaatacatcaaaactgcaggtttgcacaaaaactgaattctgctgaatgcaaacaggcaaacagcatttaccaggaaacaaaacaaaatcaagcacataaaaaagtaggaagagttggaaaacggaaggaagataagttctcaaacagctggaatagttgatgttagctagcgaagtttttcagaggaaaaaacaagaagttggttatgaggcaagtggacctgagaaaaaagactaaaggggaagaatagcaagtaaaacagaactccacttgctagatctctccctctgtcgcgctctttcacctgacccactcccttattccccccacaccctttccttctctccctacgttaccgcacaggaacgaagtctgggtcatgtgcggaccgcttgtggctcttaaatcctctttttgtcaccctggccgtgcaaaattttgaaacgtccctcggcaaaaaaaataaaaataaaaaaaaaaaatctgtccctggcctcttccctagttctgggtccagttgcagccaagtgaggggcagcgcgcgctcccaagtccccgtttcagagacgcgcacgcgcctggcgcccaacccccaatcccctgctgctcagtgaccccgcccacgggtttccgggccggcgtagctatttcaaggcgcgcgcctcgtggtggactcaccgctagcccgcagcgctcggcttcctggtaattcttcacctcttttctcagctccctgcagcatgggtgctgggccctccttgctgctcgccgccctcctgctgcttctctccggcgacggcgccgtgcgctgcgacacacctgccaactgcacctatcttgacctgctgggcacctgggtcttccaggtgggctccagcggttcccagcgcgatgtcaactgctcggttatgggtaagccgccggctcggcagtcctccgggtcgtcctttctgcccttgagcccctaacgcagcgccacgccaactaccgcttccccccaggcagacgcttgtgggtggccagagcatcttgactggattcggggacccttggggaccttcttccccgccaggctcgcgaagttaaagttcatctgctgagaacttctaactccacactttcttggttatcttggggactcaacactttgatcaagaacttttttattcctcccgcttaattttgtttgctttgagagagacttgggaactgcaatcgtttggttctccagtccgatctggtagcgttatttttaaaatttatttttattttttattactattttactagtgaagatagatgagctcagagactctcgaggatatagcatgaagttttctctttttgttagatggtgggaaagggactttctgcccagcgattttggtttgagcgggtgttgatgagtactagaaaacggctagtaccactctgcattgtttcatgcattgcaaggaggtaaaaattttttaaaaaattaataacaaagaaaacttaactctgaacctagtaattagaaatgcccagagtctgcacaatgtttggctcatggaaggctctcaataaatacctagtgtttgaacatactggagatattccatatgccttcagataacatggttacccctagaacaaagaacctagtgaagggggtggggtggaaaaaagacaatcactagttagaagagtcacactgtggtctacccaaaccctcttacagcctgtgacttctgcagagtcagtaaaaaatcagctataattttcttgtcaacagaacaaagattaagtcatttgttactaaagaaatacctttttaactgactgtatagcatttcataatcctgaacattgtaacttttttttttttttttttgagaatggagtcttgctctgtcacccaggctgtagttcagtggcgggatctcggctcactgcaacctccgcctcccgggtttaagcgattctcctgcctcaatctcccgagtagctaggattacgggcacatgccaccacgcccggctaatattttgtatttttagtagagacgggtttcactgtgttagccaggatggtctccatctcctgacctcgtgatccgcccgcctcggcctcccaaagtactgagattacaggcgggagtcaccacgcctggccttttttttttttttttttaaatttgagtttgaaggttggggcagaaagagatcaggatttgcactgccctgtcacatgcaatctcccatgtcagagcattaatctcaaacatggaaaaactttaaaatacacaactctccagatggacacagctgaatcattttcaggaaggctctgcctataaaattacctttggccttaattcagtaattaaaggcacccacaggtctgagccctcatctatgaaggttaaacgtatcattcctatcagcactaattggttttataggatacagacctctagtttgctgaataaactttggaaggattcagattatgaggttctaaactgtagagcctttgaggagaaaggtaccccatttcttctccgaatagatcattttgtgtcttctcctgggcttagcacattgtcttccttaggatctgatagtctgtttatttatctttttgttgtcataccttttattcttgcatttcccacttttgactagcattttgccttttctccgtttctggaagcctgtaattttcaacattccccatttctccttttgttcagtggaaaaatttcttcagtgttgggatgctctggaaaggtactgtagttttgggggtctccctgcctgctgggctgcatagcatatctctcttttttgagacaaggtctcactgtgttgcccaggttggaatgcagttgtgcaatcatagctcactgcagcctccaactcctgggctcaagcaatccttccacctcagcttcagccgctcaaatagctgggactacaggcaatgcaccaccataaccagcgaatttttaaaaattatttttgtagagacagggtctcactatgttgcccaaactagtcttgaagttctgacctcagccccgcaaagtgctaggattacaggcgtgagccactgcttctgcttgcattatctcaaatttttagagcctaacttcacagtcttgcctcggagcaggaactgtttgaggcaacaagatggagcctctggtttcttcactaggcagactgtgctcaaactgggtagcatgaaaggaaagcagcacaattataattgaaattgggggattctttcccctattgaaatccaaataattttcctttattgtgctttttttttttttctttaggaccacaagaaaaaaaagtagtggtgtaccttcagaagctggatacagcatatgatgaccttggcaattctggccatttcaccatcatttacaaccaaggctttgagattgtgttgaatgactacaagtggtttgccttttttaaggttagttttgttggaagttggatttacattttcaatgatttgatatctgaaaactcttctgattagtagaccctcagaattttaattttagattaagaagttgaccggaattgacaccactcttcccaagagtagtagtagttggtataattttgccactttatttaaaattatgattttagtaggtttacaaaataccagtgctacatttgaatatgtataaattatgtttaaaatttacattttggtaagtatgactaaattcttaatttattttcattattactaccactttatttctaaatgttgccatagtcatttggctttgttctaaatctgtgggaaagatacagagattacacattttgttttcttgcagttactatgctgtccttcctatcactacctgttggctgaggtagtgataggcctaaatgattcattatcttaaaggtactaaatatgttgagtaattttttcttctaaactaacagaaagagagaacctaggagttactcccttaggctggttaaagtgaaaggtagccaagtcaacccagcttgtttccttctctcattaggaaagaactattgttcattctcataacacactttttccaattgcaaacatactcagggttaaaatagtttagcacaaattgcagcccatttcatttgttcttcacaagctggaacttttcttgtaagctaaatattaaatggttcaagtaaattggatacataagcctgaaactaggcgtttctcattatacatagagtataaattaagacagactttttcatggtgaaaggtttacagcctttaaaacatctgggaagaagtgggaaagtagggaataactctgttaaatatgataaaagacaaagcaccaacaaaggcctagttctaaacttgttataatttctcatgggagttgtggtttgtcacaaggttatggcggtccaagcaagtttacaatattttttagaataataactcccagaaatatttttaaaataaggacctttctttaatatggaaaaaaaaaagatgaaatagagaggaagaggttgcctttcctcaactggatttgctggtgtgatatgcagctggtggaaaccagtttgtccatgctagctgttgatggccaccagtccactgaattagtggaaacccatgcttaaccagttgttaactatttttagtatcatttccagatgctacgcatttttttgtaaaaaacatacttacaatagtatctatataaatttttaaaattgtaatgtatatgtggtatatttaacctgaaaataatctttggtgtatacgttgatgagcctaggcctttgcagacctcttacagttactctgtcacagcccttcaaaggttctttgacttcagattaagaatcaattgcatgtggaatgcatgtgcaaaggaagagatattcaaggcaattgttaccatgtaccataaaccttgtacataattttttgtcattttcttttcctctgtctctatcccttcttctttgacacacaatagacacctagtcaatttattacaaaaaaaatgaatgaatgaagtggaattcagttgggaaataggttaaataaattatttaggagatgaggaataggtaaaaagagacaagtacatagtttattcttttgacttagaaaacttttgattcttaaattctgcagaattggagaaactggtggggaaacttctaaaatcattatttaattaccagagatgtaatagatatagacaaaagcagttttcttcttttattattttttcatcagttagttcttagcttaaatagtagtccaaagctggtagggacagagggaattagctggtggctgaatgaggaattgtatcactttttgtgaatcacggtgtaagcacatttggtgttttgccattgcctaagaacattagtcacattaggtcaatagaaaatcactttttaaagccaaataaagttatatgtgttcccaaccatgagttggaaagaattaatatatatgctgttggagggtagaaccctgcctaatcatatggttctggatggcattgatcgaatccttattctttcattaggaataacaatagaaaaaatactcctgccctactgatttcaggatatgtctattttaaagtgcccatttgacaaaaccattatcagggccatgttttctttttctgcagaaaaatcaaccactctggtcagtagttaggtcttatgacaagcaccataatttccttaggcagagtagaatataataggatacttctttttgaaacttaatataatcaggtagttccagataaacatagcttgcaaagtgataaaataccatgttattttagtaaatccaattgcaagagtgatgggaaacagagtttaaaaacttaagaaagatattaagatggagttgactttgaataataaagtcatccactgttgatgggtgacatttattaatacagaaagtttacagattttaccataagcatcagggtatttcctgcagctggggaaaccgtgcttgaaaggatgcgtaactcaaggaaaacacaagcccatgtaataagtattgcatgtgagaattgttcctatagaattagaaagcatcttttacattaaaatttatttttgtaaaaagagaaaacatcaaaacttgagtagtatttgctattcaaagagtcttacataaacgaaaacatactcaacctactgccattacagaaatatttgacaaattcttgccatgcttacctgccatcgttgttgttatcctacaaatcaattggattttcacgcctctccactgactggaaccctacaacttgcttccttttatcctctttatatatgcttcagatatgcttgaagtagattgtttcttattgttcttgctgctcgagtttgttgagtagttggtacatgcagagtatttgtatgttatgacatatataggttttgtccatggttcctggctcataactcactcccaagacccttgttacagaaaccagaatctctctctctgatcttctcctaccctcctttcatctgcccactgcagaactctaatctgattatggtttctaagaccctcataccagagagtattctgccccataccatagcagaaggaacactgcacagagacaccaagaagaatctgaacagacaggccttgttaggtttagatcatgtccttataacctaattatattttaacatggttatccatgctttaatcatgtgtattcaatgaacgctccataaaagcccaagaagaacagatttgagggaattctgaagcgctaaacacgtagggtctgacaggaaggtgaagaagaactcatcatgctggaagggtggtccaccctaactccgcagggacagaagctcctgtgtctgggacccttccagaacttgctctatgtatctcttcaagtgcctgtgtatttatatcctttcaaatatcctttgtaataaatcataaacatgtttccctgagtttttatgccactctgtcaaattaattgaacccaaagagggggttatgggaaccccaatttgaagccagtccatcagaagttctggaggcctggacttgagactggtgtctaaagtgggcaggcagtcttggggactaagccctcaacctacgggatctgaaactgtctcctggtaggtagcattggagttgtactggagggcactgagctggtgtctgctgcagaattgattgcttgcttgctggtggggagaacttcctacatattttggggtcaccgaagtcttttgtattgattgttgttgctgactgagaataggaaaaagcacgttgagtagtttttccacaccacagcattcttttaggctcctgcttttaccttctgcttccctcagcatcctgcatctcaccaggagagacacagcttctttgccattctcggcattccacttcggaatcaatcagaatagctcctattgctagaaacttgctttattaagttctgtttattcagggcttatctgaaagagaaacattttttatgatttgagatttctaagccattttaaaacttggttttaacagcttgagaaattgggggtatagtagggatggagatacatatatttggatgtgacttcaagctagataaaagtttggaaggaataaaagtttgacatctaaagtttttgcatagtttgagttgagcaggaggtactaggtatgtttttaaaatatttttttcagccaggcacggtgactcatacctgtaatcccagcactttgggaggccgagacaggcgatcacctgaggtcaggcgttcgagaccagtctggccaacatgaagaaaccccgtctctactaaaaatacaaaaattagctgggtgcggtgacacatgcctgtaatcccagctattcaggaggctgaggcaggagaattgcttgaacccaggaggcagaggttgcagtgagccgagatcacaccattgcactccagcctgggtgtctcaaaataataataataataaaaaaatgaaagattttttcttactcagcatcctccaggcattttattatctgagcactttatgggagttgcatattacatttagggcccactcaggtggttgggtatctaagcatttgaaataaccttatgtaaactaataaggagtaatcaggcctgtggcaagatggaaacagtcttagaggcattcaaattcaaatttcctttaaaacactgggctggccaaaacaaaagacaatactatctacaggccagtttctaagattatcagattttagtagcatttaccatttcattgtacttggcacactttagcaaatttgcacttcttaaaagtacctgcaggcaatctcctatataaaaacacaatgcaggctagcttggctcctgcctttaattccagcactttgagaagttggagactagcgtggccaacgtggtgaaacctcatctccactaaaaatacaaaaattagccaggcatagcggcgcacgcctgtagtcccagttacttgggaggccgaggcagtagaatcacttgaacgctggagacagagcatggagtgagctgagattgcaccactgcactccatcctgggtgacagcgtgagactctgtctccaaacaaaacaaaacacacacacacacaatgtaacaacacgaaacagaatactgtgaaaatgcttaattatgtctgactttacatgatggctggatatgtgattattttttcttctttatgctcttatgtactttgttcatttttaatgatgatcatgtataaagctcctctgtgtagcattctctccaccaaattgcccagagacaggaagtcctgtaaaacaaactaagctccaaaaaatgacctcctgttgaataggctttttttttttttttttttttttttttgaaatggagtctagctctgtctcccaggccctcgctccttccacctcctgggtttaagagattgtccttcctcagcctccagagtagattggattacaggtgcccgccatcacgcccagctaatttttgtatttttagtagagatggggtttcaccatgttgaccagactggtcttgaactcctgaccccaagtgatccgcccgcctggacctccccaagtgctgggattacaggtgtgagccaccacgcccagcctgaataggctttctaaccttctactgtttctcattttactttctctgaggcagtaaaagaaactgactctaaaagggagcagtagagaaggaactcagattttattttgaagattaagctactcaagggctgaggaaatatgtagaggggaagtagactcattatggctggaaattttatttggtgatagtgaagcaaatcttagggctttctaattgagctcttgtttgaaaggctccaatcttaatagaactataagctaaaaaaaatgaccatcagtgtttctaaagcaagttgctactcaaaacaagaacactttgggaggctggggctggtggatcacctgaggtcagaagatggagtccagcctcaacatggtgaaacccctctatactaaaaatacaaaaagtagccgggtgtggtggtgcacgcctatagtctcagccacctgggaggctggggcagaagaatcgcttgaacccgggaggtggaggttgcagtgagctgacattgtgccactgcatttcagcctgggtgacagagtgagactctgtctcaaaaacaaaacaaacagaaacaagaactctatgttgagaaatccatactagagggtttaatttctcactttgtgtgctagtgattaataaatttcaagcttatcacacagccagaaatgtcacctgtgtttctacaataaaagatttgggaatattgtgacattttttcactgagccttctgggttcattattaagatataacaattttagaagacttattgagataggtatactttttaaaatttggattcaatatatcaagctcagcattttgtcttttttttgttttgttttaaacaactttgggtttacttgtaagagtatttcagtggaggaaaagtatcagaagtttagcactgagtgcctgcctaactattttatgtcttctttcatgatgatgcttaatctcaacataatgactcagtttaccattgtaaactctttgtaggatgtcactgattttatcagtcatttgttcatgcagctgggaactgtggggatatatgatttgccacatctgaggaacaaactgggtgagctccattgaaaaatttctaactttcttattaaaagcaagcttcctcacttcctgatggcttatgcaaattaatgcctatttattcatcagagggtgactggagagattatggttttcttatgaatttcttgcttgagcctgcttgtctgctgtttctaagttgtctgcactattttatgtgagtaattttctactttattatgttctgttttcacatgtcaaatcagctctcccaagaatgctacttgtaacctaagtagacgtgaaccgaaaagggtaaagacccagctaaaaaaaaggttgactcaagttcagttcacattcgtaaagtagttaggctgccttaggttgcttattcttttcttgaaaagaatccctcaagagagaaacatgtgaggccacagcagcttagatctgtcttccacagagaaggtggcttttacagagaaattgacatactcatcacttatctgacatgacccagctttgtaaaactggcttctattaaaatagtcttaatagactattcactgaggaggagagaatcttattcactctttacattctcttcacattttcagaatagatgtttaaatcattgctcacactggatccataaatgtctaaaatgttgatgaagaaataggtgattagagagtaaaattaatagagacttacccttccttgcattttaacataatattctttccccttttccttcctctgttacttggctcttaaataccagaagtgagatatgaaaaagggaactggggacaagtattgaaagcaccataggtttatcttatattagcattttccaaactttataatgaaccagcagtgacccacacatctgccaggtaggaattgctcatcagttgtgtcgcgttatcttgttaagcttcagcaatgttccatacagccactaataacagatcaaagtgagcattagggttgaaattagtaagctgtttcttctcagttctttctggtagttgaataaatatagaatgtattaaatagttttctttatttcagaacttctcagagtctgtaatatattgtatggtggtagcttaggaggaagatgcaataggaaacttttcccagataggttcactattttttttttccacgaaaaataagctgttctcaaaatacagtttacaaaattttatccttaactcttcactctttctcctagttagggagaccgctccaccagtagaaaagataaaccctggtaatttgttgtgtaaatgggataaatagcctagtacctagtcatgtggattcaggcagcactgagcctaaattaaagtttgcaaggtatacatgttaatgtatctaagttactatatttagcctgtttcttaagtatgtttcagagtcatattcgtttttttcagtggcagttaccttcagatgcatgtgcttctaaagcatgttggttgcatgtgcagtacatgttgcttaagcatttagcttcagaatggcatctttcctgtgaatgtcttaacatttacaaaaaagtaccaggatctcaaatatcagtgctggtatttttttttttttttttacttaaagaaattgatatgattaaatattaagagacaatatgatccttgttggcttgtaaccctagtttttattgtcttgtagttattaaatagagcatctgttgagggactcttttaaaaccacagccatgaacagacgttggggctaagagacagagcagcctgcgacagtgtggacctacctgtagcagctagcaaaggcctctagcagctacagtcccttctggagtctttatttgcatgcaaaatgcaaaggagtcctggtgacctacctccaaggcagctgccctcctgaacactcccttggaaaacagtaaacatcattttggaatgtgaacaaccagagactacacaggagaaaggaaaaaaaaattctgaagatgcaaaatcttgggtggcttcaccgttcagttttttaataaaaggaacaatatacaacacgttgttctttttctcttttgaaatcccttctattacagtgatttttttctaagattgtcaggatttgaagtgtatgttttgttttattcacagcgtaaattttattcacagtttaactgtctgcctgagtgtctttcctttctctaattaccttgaggaacccaagagcctgttgtaaggagaaaataaggcccttggatctcttgagattcacagatataagttattgaagggaagatggtcctatggaggacatatttaaagaagggaaaaaagaggctttctcagatatgtcagactgctatagtatacttctacagattatagacctccagtacctctggccagaaagatggtatcgtaaacaccctattttttttcttttcttttttcattaggtacaagctttgtgctaagaagttgacatactataagctacaaaagttctgtaaagtagatataactagtttcattttatagatagagaaaattaatctcttacagtgctaagctcacagagtttctaactgtaaaatgctagaacttgtctttcaagcctaaagacttccttggggctaaatagtgaaaaaagccatttcacaaataagtaaatggtatttagaggcatatttggatttcctggtaaattccagtctgtgagcatcatgaatattagtttaatgttgcatgggctcatgttgaagttttaagagaagaactgccttgaagcttaggtttccttagctattaggctactgactttcttgcctaaaccagggttttttcattgaagaccaaaacttaccttctccttcagtttgtagtttggaaattggtagaagagctttgtaaacttcaaattaagtacaaactaagtgtcatagtcaaatttactaatcttaattacagtattgttcaactgattgctatcttctagctctttcctgccgaataatggtcttgtttcctgctctgttggtttagagctgacttctttcagctttggtaagcctgaaattatggggttatgtttaattcatattgtctgggtggactttcctctcttgcatttctgcttgaatagaagaatttttctctagagagtagtttgtcatccttactctgttgattcagatgactctttgtatgatctgagaggtatactgttctgctattctgagaagaagtatttcagaaagatgaattaagagtacagtggactgctcccacctggaaacttttatctatctcacctctggacctgataaattctttatcactcaggaccttgatgacgctgctctctgaaaccctccccagctctctctattaccgtgagaaacatcagaactttggttcccattgcatatcgcaggtacctctgctttcatgccatgctgtaatggagtgattgggtagcatgttttcatctctttccagattgaaaatctgtatttctccctgtatatcttcaacacctaatgcacatagaactttgtaggtacctggaaaatgcaccacagttttcttttctttttgcagacttttcacaagtattaccaacttacaaagaattaattttgtaggattctagaaagacaaatcaggaatggtgccatatacatcttttttgattccctgctctaaagaatattatcaggttaccttcctgcagagttttaaaagaattgcatatttcaagctgactttcaggatgtaaatataaccaaagcaactgatatgtaaaaaatatattcaatggcattcctagattttcttctagggtgttttattgttttgggttttacatttaagtctttaatccatcttgagttaatttttgtataggtataagaaaggggtccagttttaattttctgcgtatggctagccagttctcccagcaccatttattaaatagggaatcctttccctattgtttgtttttgtacggtttgtcaaagattagatggttgtagatgtgtggtcttatttctcagatcttcattctcttccactggtctatgtgtctgtttttgtaccatgcttttttggttactgtagccttgtagtatagtatgaaagatagcatgatgcctccaggtttgttctttttgcttaggattgtcttggctatacgagcttttttttggttctatatgaattttaaaatagtttcttctaattgtgtgaagaatgttaatggtagtttaatgggaatagcattgaatctgtgaattgctttgggcagtatggccattttcatgatattgattcttcctatccatgagcatgtaacgtttttccctttgtttgtgtcctctctcatttccttgagtagtggtttgtagttctccttgaagagatccttcacttcttctgtattcctagatattttattctctctgtagctattgggaatgggagttcattcatgattttgctctctgcttgccttttgttggtgtatagggatcctggtgacttctgcacattgattttgtatcctgagactttaccgaagttgcttatcagcttaagaagcttttgggctgagatgatggggttttctagatataggatcatgttatcttcaaacaaagacaatttgacttcctctcttcctatttgagtacgctttatttctttctcttgcctgattgccctggccagaactcccaatactatattgaataagaatggtgagagagggcatccttgtcttgtgccagttttcacggggaatgcttccagcttttgcccattcagtatgatattatctgtgggtttctcataaaaagctcttattatttgagatacgttccttcaatacctagtttattgagagtttttaacctgaagcgatgttgaattgtatcgaaggccttttctgtgtctattgagataatcatgtggtttttgtctttagttctgtttatgtgatgaatgacgtttattgatttgcatatgttgaaccggccttgcatcctggggatgaagccaacttgactgtggtagataagcttttggatgtgctgctggatttggtttatcagtatttcattgagattttttgcgtcgaagttcatcagggatattggactgaagttttctttttgttgccgtatctctgccaggttttggtatcaggatgatgctggcctcataaaatgagttagggaggagtccctccttttcaattgtttggaatagtttcagaagaaagggtatcagctcctctttgtacctctggtagaattcaactgtaaatccatctggtcctggactttttttcattagtaggctatttattactgcctcactttcataacttgttattgatctattcagggatccaacttcttcctgattcagtcttgggagtgtgtatgcatccaggaatttatccatttcttctagattttctagtttctttgcatagaggtgtttgtagtattcgctgatggttgtttgtacttctgtgagatcagtggtggtatcctgtttatcattttttattgtgtctgtttgattcttctcttatttttgacaaagctgacaaaaagaagcaatagggaaaggactctctattcaattaatcctactgtatatctggctagccatatgcagaaaattgaaactgttcctgtttcttaatccatatacgaaaatcaacttacgatggattaaagacttaaatgtaaaacccaaaattataaaaccctggaatagaatataggcaatatcattctggacataggaatgggcaaagattttatgagaaagacaccaaaagcaattacaacaaaagcaaaaattggcaaatgagatctaattaaactaaagagctctgcacagcaaaagaaactactgtcagagtgaacaggcaaccaacagaatgggagaaaattttttcaatctatccatatgacaaaggtctaacatccagaatctacaaggaacttaacaaatttacaagaaaaaaggagccccattaaaaagttggcaaagaacatgaacagacacttcccagaagatattcatgtggccaataaacatgaagaaaagctcaacatcactgaccattagagacgtgcatatcaaaatcacaatgagataccatctcatgtcacaatggtgattattaaaaagtcaaacaacatactagtgaggttgtagagaaataagaacgcttttacactgttggtgggaatgtcaactaattcaaccactgtggaagacagtgtggtgattcctcaaggatttagaaccagaaatatcattactgcatatagacccaaaggaatagaaatcattctattacaaagatacatgcacatgtatgtttattacagcactattcacaatagcaaagacatggaatcaacccaaatgctcatcagtgatagactggaaaaagagaatgtggaacataaacaccatggaatactatgcagcaataaaaaggaatgagatcctgtccttttcagggacatggatggagttggaagctgttatcctcagcaaactaatgcaggaacagaaaaccaaccaccacatgttctcacttataagtgggagctgaacaatagaacacatgggcacagggaggggaataacacacactggggccagtcagggggtggggggtcaagctgagggagagcattagaaaaaatagctaatgcattctgggcttaacccatttatgcctagtgttccatttctggaatgctaagcatgtggaagttctttatatcctgctcaaggtcattgccaaggtctgatttttcacattcaacaaattgcaacctctggcataaatgggttaatacctaggtgatgagttgataggtgcaggaaaccaccatggcacatgtttatctatgtaagaaacctgcacatcgtacacatgtaccctggaacttaaaaaatttaaaatatatatgtatatatatttaatatggaattttaaaaattactaatgagttcttttatctgagtaattttgcatcaacatgcttttattatggaagagaagattcagtgagtacaaaattgcagatacatgtgtcagaagatccctgaatataataaggcttagtattctgtgtcataattgcctgtttgtattcctctctggtctttaaacttcattagggcaaggatcaactccatcttactaaccatttgattccctatgtattacacgatatatgaccaataataagccttcaataaatacttgtaaaataaagaatgttatgtaatatgtcatgtggtattgttttattgatgtgttctttgaagtgttacctttgtgtccttagaggctatggtgggccctcaggccatatatgttggatgatttagtggaaaagagattagacttttatattttattctatttatttatttatgttttaatcttgtgtaagcctatagaggccaagatagggctcagagttaaaaacagtgatgttctaactttcaaaactactaaaaacaaaattagctatcaagggaaatcctgagtgttctgactgcaggggttccccaaagcctggaggaccgaagctttgaaatgctgcatggtgtgcctcacctctgttgagtatagtgaggaacatgagctgaggagtggattagatgaactcttaagatttttttccaactttacggtttgagtttatgagtaagtaagtgaggaatgagcccagggactttgactactttgctgtgcagtaaattgctgttttcttagctaattctggagtgtgtattttggttttaatgtaatgtcctttcagcactggaaataaacagatttatgaccctccattttcacatgtaaacttccagttccttcagtaaaatgctggaagttgcttggctgtaaccactgtaactatttcctggcagttttgcattttattacaattcgactttttaaatgcatggttcagtccagttaataggcagaaaactatagctattccttggaactgacatagggaagttggtttctttctgaggaaagatgtgacactctgatggatttggcaaaataccaattcagtaaaatttgcctggttcctttctgacagcaaatggaggtaattgtacgtatatagatttctacagtaaacaaagggcaaaaatggaaacattttttgttttttaatgttgctggaatataatatttccatatttggttaatcatcaaatcattcaactccatgcaaagtactcttttcaaaattacaaatcatcttgatggattagacttggatgtctaaattttttattatgtattctaaattatctataggtacattttgaaaattatatatacatgtatcactgtactacatttgttataaaatgtgaaatattaagcgattaaatactttattaatgtcataaaattgtgccctacccaaaatatattttaagaagatatcatttgaaaataatgtaaaatattcttcattattatgattttgttgccaaaagtaatgttagagtccctgttactgataattttcatgactgtaaattttcaacatttggaaacaaaattttctgatgtgttttaaaatcttaaagaatttcagtagattttgacacatttttgttaaaagtatgaaagtgtcacagctttagaaggatttagaataattatcaattggtattagggatgacaattttaatagacaaattttaactgaaacatttgctttattgatgtctaggactaaaaaaaatattatagtgatggaaccatttcaaaacatctgtttttaaaaacttctgtcaacatgtttgacagaagtcagaatagggtaattataaaaaaactgccattttcttatgtttgcatcattagtatttgcaaatccttgtttctttgcaagtatattttaaactacttgttcattttatgagtgttagcctgattaattcagataagatgctcaagtcagtttaagcaggcagatgtgaaaaagggaatatgctgtgccttaactatcttatagggacttactagcacactgtacataacagatgaacatctgatattagatctgatgggcacaccaatgttgtttcatatattaaataatagtggaagttttcaatttaattagtttatttatttatttatttatttttgagccggtgtttccctctttttgccaaggctggggtgcaatggcacatggttgcagctcactgcaatctccacctcccaggttcaaaggattcttctgcctcatcctcccaagtagctgggattacaggcgtgtgccactatgccaggctaatttttgtattattagtagagacaaggtttcaccatgttggtgaggctgctctcaaaatcccgacttcaggtgatccacccgcctcagcctcctaaagtgttgggattacaggcatgagccactgcgcctggccaattgtatttttatgttagaaatatatatgggagttacaatactttgtttccaatgttccgctggaaaccactggttgaaaggataggtcccagtgtcagctgcccagttggcagttttggatagaatataagttctatgaaggcatggatgaagtatccttcatggtaatgatggtaatgttagtatagtcacttgtttaatgttgtataactttttaactcttccaacttcaatttcatctatatctttcatagcagtccagtaaagtagtatcaattatagatatcattcctactttcagataaagtaactgaggctcactagttttgacttgctcaaggttacgtaaatgataagtgacagactggatttaaagggcggagtccactttactaaactgcctctgtcttctagccaagtttgttatgtaaagtaagtattcagacattggctaagtatattattaatcaagaaaacagtagaacaggtttaaggaatttttttttccctctcctcagtgtcaaaaagcagtcaagtaaaagatccaagataaataacttcagttcccaaaaataacttcaattccaaaatttccctatgactaggtatatctaattggatagctgataaaatgagtgggaaattgaagaagggatattttgagaatgtgtggcaacttaatggtaatattgaagaagcaaatggatagttattgaatcataatagttttttaaacttaaatactagggcttgatcttcatattttaggaaattatctatttgttgcagtagaaattagcataaatgaatggaaacttaaattatctcatctgtgcaaggcagtcttcagagactgatgtttatataagtgaaaactcagaaaaattttttggctgcatttcaagctggatagcggggtcaaaacttcaacttcttaattggtgatacaacgtcagaaatcacaaaagaagtatttcacaggaaaaaatgacataccccgaaaacattcaaatcaagaaaatcacaggggtacagtggatggtcccccttaaggtactgcgtacttggcttccccgctggtaaatgcctctcttttactaagttgttgtcgtgcagagtggcattgcagctctgtacttttacagaataatttcaggttctaaaattgatacattatttcagattgtaagaatagtataaaataaaattttaaaagggaaaataattccatcaatttaatggaatgtgtagggtttaagttataacaacaaaaacaaagttgtagttttttaggattactcatataaatagtgtgtctattaagaattactggctttatgaatattaaataagaaggctggccgtggtggatcatgcctgtaatcccagcactttgggaggccgaggcagacggatcacctgaggtcaggagttcaagaccagcctggccaacatggcgaaaccctgtctctactaaaaatacaaaaattagccgggcgtggtgacgcatgcctgtaatcccagctactcaggcggctgaggcaggagaattgcttgaacccggaagacggaggttgcagtgagctgagatcgcgccactgcactccagcctgggtgacagaacaagactccatcttgaaaaaaaaaaaaaattaagacaaccacagatataaggatttgcaattagaaagcttgaagggaaatttttggaacttctaggtcaacctaaaattacaaatagggaagcagctttggagaggaacatttgcacttctgaagtaatactgtgatttggactgtcagacattgtgatatattggcatcaccacacctctgttaattataaacttacctattctcagtgccttgttaactgttgaaataggacttgacatttgttgttcttcctcttctgttattcatttattcactcatttagtagttaattacttcctagtgccagatagttttctaggtactgaataaacaaaaatcctattgtcatagttatgtttttgtggaaagaacaacctgatagactatcgtgaaaaataaatgagttagtatacataaaacacagcccatgagatatagtctgtaattatcatccctgcttcatttatttatttatttatttatttatttatttatttagagaatggatctgattctgtcatccaggccggagttcagtggctggatcattgctcactgtaacctcaaaacacctggcctcaagtgattcccccaacctcggcgttccaaagtgctgggattaaaggcatgagccactgtacctggccattgctcctgttttaaagatgaggaaactgaaagtacagagaggaacgtgacttgctcaggatcacacagccaatcagtggcagagcagtctaggcagtctaggcctgaaggcattattctttctttctgttctgcgtcaaaaaccctaggcaggcatggtaaaaagactgaaagagccaaggcaacataggtacctgaagaatgggagaacacctatgaggactgctagaaattttaggcagccctttaaaggccttgggcaacaatttgaacgtgactcatgagtcagttaattctctgcacctttttttttttagagaatacaatggataaagcaatgacctttgtaacatgtaaacctgtatttgaatcctttcctctccatttaattttgcagagtcaccttttcttcattagaaagaaattttatcccaaagagattatcgtgaggctcaaataatataggtggaagccctttgggtttaaaaaaaagccttttctgtcatttctgggtatctcccgtcagtgattttagtaattgtttacctctctggctcttcgtgagaagacaaattgtaggaagaagtggaggatggcattgggtaggatgcttagttctagttccaccacttccttaggtcttttttttgtcccccaagactatatcatttctgtgttctcttgaacctgtaagatttatgagtaatctgtacaatatttataaagtatgaaatctctgccattgtggcacaaaagtagccatagacaatgtataaatgaatgggcatgctgttctccagtaaaactatatttatagaaataggcagtcttctccaattttagtttgctcacccctttcctatagaactcaggtttatcatatacaatgttacacattattcctttgaataaattgtttacctaatactttttaaatttgggcattttctaggacattctattgtttttatttttaacttgtgttatactgcagtgaatgtcttcctgtgtgtagcattttgtttgtgtatgtgtgtcaatatctataaagtagctcttaagaactctggaaacattgtcagactgcttcctcaaacagcagaggtgggagggagcatcggcctaaccctacctggcctgccttaccagcatgcaaccaaggagaagagaataggatcaagagccagtgccagagagaagtacataatacaactttatggagtttaggttgcatcctataaagttaccatgttacactgtttcgatctaccaaagtagaagttttacatagtttagtatgaagttaattttattaaccttttcacacaacacaccctctcatattgctgcccaacaatgtcctgggtctttgtttccatggtcatcatattgagtagggttttagcagggacttgagtagttgggaactgaactcatgctagtgaagccattcttcactagaagcagacatatgggatccagaatatcatgaacaaccagctgggtacagtggctcacacctgtaatcccagcactttgggaggctgaaggaagcagatcacctcaggtcaggagtttgagaccagcctggccaacatggtgaaaccctatctctactaaaaatacaaaaattagccaggcctggtagcacatgcctgtagtcgcagctacttgggaggctgaggcaggagaatcgcttgaacctgggaggcggaggttgcagtgagccgacatctcgccagtgtactccagcctgggcaacagagtgagactctgtctgaaaaaaagagaatatcatgaatatcaccaaagataaaagcaagatgcggatatgagtagcccagagtaacttttcctgtgctatataacacagtgagtggtgattcccacaattcaagtccagtttttctggattctaaagccatacatttttaactctccccctaaatatgatttgaattcagagagtcagatgcaataaggtaattttaactttaagtgtagtttagcccacacatttctctaaactgggggttggcaaactacaaacctctttttgtaagtaaagttttattggaacacagcctagctcattcatttatgtattccctttgcaccttttaggttgagtagttgtgactgaggtcttccagccttcaagcctaaaatatttactatctagtccttcaaaaagaagtttgccaacctctgcaaacaagtgaaataatgtgtattagagtagagcaggagtccacaaactacaacctctggagccaaaaccaccctactgtctgtttttgtaaacagaaattttatagaaacatagttgacccctgtgccaatttgtttgagtcttgcttttgatggcttttgtgctacaagggcagagttgaacagttgcaagagaactaagtggcctgcaaagcctagtggtctttgctgtctggccattataggaagtgtttaccaaaccctgcatttgatcatggaatcccagaatgtttatacctttgaggatttttttttctactttccatattttacaggcaacagaactaaagcctcgtaaaatcttgcccaaggttctacaaatagtcttttctattaaattaagtcagagcctgaaattgtctgtgcccaagtctctcctcagaaatttagcacagcattttccctttctgtctcccacatgctacacagtcatcctggatcatgtgccccgcctccatgaggagatgttctaacatgagggtgactaggctctggagccagagcatcttagttcaaatcctggatctgttaaaaataatagttatttttcagttctaacactgaaataagacaaaaggccatattactgaaataaagtgtaaagaatatatttaatactcaggttactttagccccctcatgatcagaatatgctaataaattgagagattgacagaaaaaaaggattctgtttcactgtggctcacacctgtaatcccatcactttgggaggccgaggtgggtggatcacttgtctggagttcaagaccagcctggccaacatggcaaaaccccgtctctactaaacaatacaaaaattagccaggcgtggtggtaagcacctttaatcccagctactcgggaggttgaggcaagagaatcgcttgaacctgggaggtgcaagttgcagtgagccaagatcacaccactgcactccagcctgggcgacacagcaagactccatccctggaaaaaaaaagttcatcatttgttcttgtagtttcctagtgtggcccttgtctcagtggaaaattgtagtgtgatagactgaggagaattctgtttctgccacttagcctgttgccttggtaggagctccttatctctgagctgagctccttttgtccttggtaaaatgtggttattatcatctgcatcctcatagtcttcttgtaaggactgtgaagtcacttttgaaaaatgccttgaatatgccagatggtctgttttctttcttttttgttttgttttgttttgttttcccttggccttcattcctggaagtgttttgttatatacattttgtttggtggccaacagtgctaaccacagaaaagtttgtatgtcttctttttctagaataattcttacagtgtaacctctcagggtgaagtttttgttttgaaaaggggcacatttactgtgaatgagagccatggaaatggacctgaaatttgaagacagattttacttggttttcttttctcttatttgtttgcagtataaagaagagggcagcaaggtgaccacttactgcaacgagacaatgactgggtgggtgcatgatgtgttgggccggaactgggcttgtttcaccggaaagaaggtgggaactgcctctgagaatgtgtatgtcaacacagcacaccttaagaattctcaggaaaagtgagttgctacaaatgagacatacgtttagttttgttttatagtatatatgaatatgtgtgtacatttttggaattttagtttgattatacaaaatatctttggcttagaaatattaggcatgctatgtaaaaccttactggaaaaataaattgaccaacattattgagagtattttttcaaagtgttccaaaagtaatggaccaatgattactttaaatgaaatcatgtaatggaccacagaattgcaaattactaataaagaaaagccattttgcttattgccatgtaataacatgttgcatgatacaagtagatacgtatgtttatgctgcaacaagtataggtgatactaattgggcaacttttaaacaagaccataaataactgaaatcaaagttcttagtatttatgcagcctgttggtttgcgagggctgccataacaaagtaccacagactgggtggcttaaggaaggttgttttttcacagttttggaggctagaagtccaagattgaggtgttgtcaggtttggtttcttccaaggccacactccttggcttgcagatgtctgcttgcttactgggctcctaaacagtcttttctgattgtcctaatgtcctcttcttataagggcatcagtcatattggattggggcccacccatatgacctaattttaccttaatgacctctttaaagctctgtctccaaatacagtcatatggctgtgatacagggggttagaatttcaacgtatgaattttgagggggacacaattcagactataaactgcagttaatgtttactgttaaattaaatctataactgactaaaccacacaaacaggagatttcaaattagactttattagttttggaaggaagagatgaaatgttgttactttttctgttttatgtagttgtaaaagccactaaaaatgtacatgtacaaatcatcccaagccaggcaacattagtaatgaatgactgcagcacagaggtaagagagatgatttaaaggaggatgaattgtctgcaaaggtgctgggcaagatctagactaattcatccccttcattttaagtttaggttttaaatagctttgtttggcttgatcctagagctacacatttacttttaacttgtttactttgtaccctatcatttaggatatgctatgtactattgtactctatttgatatttcaaacattctctcatttagtgaagaagctcccaaccggagtgctcagaacctacattgcctcacctgtgaagtgagcatgtgggactgaattgcctttgaggtctctttcagctcttaatgatctgttatcccatagtaagatacattatttttaatctcgttggatcttaaacaccaaaaataatagtatttaagacgtaggatgctatcttgtcattattttaatgcacatgtcaacacacgaggttttgctagatgttatgataaagcaagcgaaacagagcaggctactgctcctcaaatatctacagtcaatgaaatattgactggcgttgtgggaaaatatctcaaaagtattttatttacaatttaaaatatattcttttgcctaaagaaacaatgaaacaactataacttgtttttgttattgtgttagtgtagtcatacatatgatacagttttataatctgcttgataagggtacgtctctgggtttttcacactttgcaacaagtgggaaagaacttcgacaaaaacattaaaacattatcaacctggttgcacgtttttctgattattttcagtgctcttaggtttttagaccatatcaaaattctctctctacacacatgatttataagggaaagaaaagtttgcagtatgcctaaaatgttcctcaggttaattatatcttgttttgcatagttgaatgtttatggaagtcttagatagtgagtcactctgaaaccacagactcttttttaatagtaataatatggtgagttctataattcctagcatctagcacacaggtatgataaatgttttaattaagtgaataatcagcttcctgaatttttctactttgtaaatatgctctttgtgtgttgaatctatttacatatatatccaagcatttggcacaaggtaaaccaatgtggctcagattttaatgttattgtgaatcacttggggatcttgtttaaaaaaaaaaaaaaaaaggagattctgattcaggtgatctgggctgagtacttacagtatgcatttctaataaacttctgggtgttgctactgatattggttcaagaactaaattctgagtaacaagtataaaccgaatgtccataaagtataatttcttttagtatcatatggttataatgcttgcattttgtatatatgttgcatacaggttttgcttttctcttttttcttattaaaaaggttataaaggtacactgtagaaactgtagggagtaggggaaagcttggcatctcatgccaccattcagaggtaaccatgtttggcattttaaaaatgcatttatagtgtgtgtgtgtgtgtgtgtgtgtgtgtgtgtgtgcgcgcatacatatatatgtatgtattatacatatacgttaatatacatataatatacatatattactgtgcaaaagttgataaattgattatgattatgtataaactttgatatcttctcatatttaatataatatagttgtgagcactcttccatatcattaaataactttctagacattttaaatgaatatatagaaaatgaaacatcattaatcagtcccttatcttagaatatttatttcggttatttacaatctattagtagtttaaaagtacttcatggaaaatccttatacatgcatcttagttaacttgaacttttatttttagagaagacatgccaggctgttctaggctattgatacatattgccaattaccttcctgaaagattgtaccactttccacttaggcacagagtgtgaatgcctgttttaattactctatttacatcagtaaagactatatctgaaattatctcatttttggggacaggtattctaataggctctacaagtatgatcacaactttgtgaaagctatcaatgccattcagaagtcttggactgcaactacatacatggaatatgagactcttaccctgggagatatgattaggagaagtggtggccacagtcgaaaaatcccaaggtaatcaagcacacattttatcattaataaaaatatgaatgctgaataccatcctccctcctaagcagtcctaccagtgttgctcgccattttattggtcatcccagttgtaactttttatgtgatctgttaacgatctttatctcctattgatacatattctgtcactctccaagtcctatttatgagtttttctttcacatgtctgttgtttccattgccccctttccattttctacactctggcatgcagctttgtcctgtttcccccatgctatggattagcctcctgccggtaaccacctgaggggttcttcctgcctgctgcataaagaaaaaccatggcaatatagtagagaaagagcttaagagacactaggctggccatgccacgtgggggatggagttcatattcaaattatcttgtccaaagctcataggtaggggtttttcaaaggcagcttgggggaaggggtgggggtggccaggtaacagatgcttgctgctgattggttggggtgggtgaaatcacagggagttgaagctgtcctcctgtgggctgaattgcttctaggtggggccataggagtggggttgctgggtccaggtagaaccacgggtgtcagacatgcaaaaataaaataaaataaaataagataaggtaagataaaataaaataaaataaaataataaataaaataaatataaaatttccctgaaaagatatttcaaaaagccagtcttagattctacaataatgatgttatttgctggagtaattgatggagttgcatgtcttataacctctggaataacggctgacaatctctcaagtctgcgccttagctggactcaggttcctcttctccccacagcctgactgcctccattagcttcacaaaagtggttgggtttcagggcaaggcccattgtcatttaaactgtagccgaaatgacttccaaagttagcttggcccaatagcccaggaatatttaagtggaaggcaagatgggggatgggttagcttagctctctttcactctcatagttttctcactggtataatttttgcaaaggcggtttcatgcctgccatctctttcgtcgctacctctcccagttcccattcttagctgttttatgaaatgcttctagtttcatcctcttataccaagttctgggagactgatttgagtaataataaaactccagtttcccatacagccggctctgcgtgaattaaactcattttctattgcaatttccctgtcttgataatcagttctgtgtaggccgtgaggaaggagaacccgttgggtgattacgagactgtgttactgcccactacctaatggatacatttagcctggtatccaaacccatctaattatgaccataactatatttatcaccttgctctgctttcaaacgatatgacacacaatgaatgaaaactttcatttttcatcttcatttgtgctgttccctttgcctcaaatagccctcaacttgcctacagtaactgtaaaatttgccacctaaaaaaaaatctcaaaatcctctctatgctttgatgtccagcaaaaaaaaaaaaaaaaaaaaaaagttatcagtatagctctattactctcaaccagaggtggcatttttcatctttacccataagccccatggtatatttcttagtttgggaaattatatcataatactttgaatctgtctagtcagaaatttagataatttaaaaaaaaattatttttctgaaagtatagctggatctagcttaggatctacatctatctaatatagttccttaacatttgttaaatggccacggataagtcctgtaatgccatactttgctttaggatcatgtgactaaggggtaaggaattggaaagcaatggggagctagcagaatttgaaaaattatataggtaggttatttttccttaatacattgaaatagcctcaaattctcagagaatacaatgtttaatcctctaatatctgtagagttcatggctcaaatttgtattatttgaataaactactaatagattaataattactcaactaaaacactttgaaatgtgagagttcccttatctccctcgcaggcatatgacagaggtgtggcttctcacacctttggttgcccttgccctaccacccaaacccctagggggagcatgcagaggggcaggtgcagaggccatggggggtgcttttgggctctggccccacagcagtgtctaggagtggatgttggagactcctgaagcccaagtgggcatgtgttacagtgtgctctttcagcttagccgtctgcagatggcttgtgttaatcaggtcattagaccccatgccttattgcaagggcaggggtccaatgtgacagcctaagttcttgctcagtgtaccagaagaattggatcacacgtgggctggaaggatgagcacaaggttttattgagtggtggaggtggctctccgcgagacgactctcagccagagaaggaggatggaggggaaaggtgttcttcccctggagtccacttgttcctgttctcctctgggttcaaatacctcttccctccttttctgctgtgctgtcccaccactctccacagctctgtgccgctctgttcctctgctcctctggatgttcagctccttgtatctgtgcctgctaagattttgggtttatatgggggaaggatggggggcatggcgggccaaaaggcaccttttttggtgtgaaaacagaaatgcctgtcttctcttagggccttaggtcttcaggcttgagggtggggcctttgctgagggaccaccctcttctacccagtatttccctgtctcctgtccatatcaacattactaactttttcatctgcagactaataatgctaaggtgtggcatttttcaactgtgagactatgtgaaggtttttcctgtccaactgatggcatcctcccataattctacccctttcttaaaagaatcttttgcagtatttctccaagtttattctagagaatttcttgtctgtgaaatgctctagttaatcaaaattggaaaacggagcatatcatatccccttctcaaattcaccaaagtgaagtcctaatgtgtcttaatgtatctgcatgagacaggaagctgagatctattcaacaacaaaaatccaaacaagcatcaagaggaggagtgttagcacttgagcctagggagactgtggctcctgcctgaaagatgggagcctcagtcacagctgctttaccaagtgtcatatgctatgtttctgaggactcctgctaaagctcccttctccctccagccaaccacttttgttttagacaagggctgggtttatgaaggactgttttcatgactaaagctttatagaaggtttaagataaggagatggaattgagtgaagtaggaaatatgaaagcagatattataatctggcttcctgatttttcactagcatttttgtatataaattagttctgttctaagaatccaatgacgtaatagaaactctcaaagattcttaacttgagatatagggagtctttgaaactgctgaaattacagacagcatttattgtttatgagcatttctgaatctagagctttcactagatttgtaaagaatgtgggccaaaagattaagagccaatcctgtatcttgtactcaaaatgtttgtaattctcacctttttatcccccagactcctcttgctctctcttcattttcacagtgttactggaaaggggtcctgatccagaccccaagagagggctcttggatcttgtgcaagaaagaatttagggcgagtcctcaatgcaaagtgaaagcaagtttattaagaaagtaaaggaataaaagaatggctactccatagacagagcagccctgagggcagctggttgtccatttttatggttatttcttgattgtatgctaaacaagggatggattattcatgcctcccctttttagaccatagagggtaacttcctgacattgtcatggcattcttttttttttttgacagagtctcactgtgttgtccaggctggagtgcggtaaagcaatcttggctcactgcaacctctgcctcctgggtttaaatgattctcctgcctcagcctcccaagtagctgggattacaggcatgacccaccatgcccagccaatttttgtatttttagttgaaacagggttttgccatgttggccaggctggtcttgaactcctgacttcaggtgatctgcctaccttggcctcccaaagtgctgcaattacagatgtgagccaccaaacctggcctgtcatggcattcttaaactgtcatggtgctggtgggagtgtagcagtgaggaagaccagaggtcactctcatcgccatcttggttttggtgggttttagctggcttctttactgcagcctgtctgttctatcagcaaggtctttatgacctgaatcttgtgctgacctcctatctcattctatgacttagaatgccttaactgtctgggaatgcagcccagtaggtctcagcctcatcttacccagctcctattcaagatggagttgctctgggtcaaacacctttgacaacatcattaagcctcagttctcacactgtttttgttttgtttgtgtgtgcaatgatgggcaaatctctgccttataggatggtagaaaaaaggaacttaatattgtaatgactgttttgtgccagataattgctttaaactgtatcagcatcttatttagtcctgttaatgatatgaatgttatcttcataacagctgccattttattaaggacttatcagagaaaaacactgttctaagcacttgttacccattattacattgaattttcataacaaccctttgaggtaagcatgattatacccactttaatagaagtgaactgtagttttgtaatgttaggttccttgccaaatgttacacagatagtaagtgataaaatcatatgccctgaaattacattatgctgccaaacttaaatttcttttttatcctttatattagtatattcttaggtttaaacaagacaactagttaacacatactagattttgtccacagttcctggctcataactcccatagcccttgtcactatcttttaacgttggggcacattaggcctcagaagtaggcctcagaaaacagagtctctctctctctctctctctgatcttcttccgccctcctctcacctgcccagggcagcactctaatcttctcctgcctttctgatcttgggtcataagaccttcatttccaaagatgtcctgtgtcataccctaaaggaaggaacactgaacagagagaggctcagaagaatctggacaggccttgctgtgtttacatcattccctttatgtccagtcacatctctacatggttgtcagttgtgcctatttgatgaagtccccatataaggctcacaaggacagggtgcagagagcttccagatagctgaacaagtggaagttcctggagggtggcgtgttcagggagggcatggaagctgtgtgccccttcccccataccttgccctactcatttcttcatctgtttcatttgtagtatcttttataataaaccactaaacattagttagtatttctctgagttctgtgagtcactctagcaaattaattgaacccaaggagggtgtcataggatccccacattatagctggttggccagaagcacaggtaaacaacctagggctttcaattggcatgagaagtagggggcagttttgtgggacggagccctcagcctgtgagatctgatgccatctctaagtacacagtgtcaaaactggattggaggacacccagctagtattcactgtgaaattggttgcttgcttgatttgtggggaaaaacccacatgcatttgatcacagaagtcttttgtgttgacagttgatagtgttcagtgagagaattaaaaaaaaattgagtttcttcttcaacatactctctcaatgtgaaaccacagaaactatttccattcaaagatggaaatggtttgtttgcatcttagtttttatttatacatcttagaagaaatgtccaagctttgttttttctctcaccctatatataaaattacctatgaggcacagatttttatgatccttgattatatagactttgtccaaattgtgtgttttatagcattactgtaacttgttatagtaatctttgtgtatattatgtctcttaacattgtcttccatattgttaatgaccatctcatatttatctctgtatcatgtatatcttcaaccaatgtgactggcttaggagaaaaaattagtgaacaattaactagtgtttgtgtaatctatacaattgtcaaggttacaattgctatttttgaagaaatcgttgttgtttttctctttgtttcatctcagttccattttgtcatgtattcttttttttttttttttttttttttgaggcggagtcttgctctgtcacccgggctggagtgcagtggtgcaatctcggctcactgcaagctccacctcctgggttcatgccattctcctgcctcagcctcccgagtagctgggactacaggcacccgccaccacgcccagctaatttttttttgtatttttagtagggacggggtttcactgtgttagccaggatggtctcaatctcctgacctcgtgatccgcccgcctcggcctcccaatgctgggattacaggcgtgagccaccgcgcctggccccttgtcatgtattcttaacctgtgttatatctaagagaagctgtgagagacgggaccatttgtggataggtgcagagggcatgaagtagcccagaaagaatctttgccattgactaaattttagcctagtaaaaaacatctggtaaccactgaaaaactagaacagtgtgatatgacaatgcccagttgaataagaaattcaaatagtttatagtaacaaaaaataatttttaccacattgtgactagtgccctaaaaacaaatttgaaggagcagagagagagaggaagtgagttttcgctgggggctggtgagtggaggctactttatgagcagttttgaaaattacaagttagggaaaaactcttaggggagttttaagtggtgagcaacaggcacttgaggttacaggagcagcagcataaagatatagaacagagaggccatttggcagtcttggggaaactccaagaagtcgaatgtgtctaaagctgtggttctctctctgtgtgtgtgtgtgtgtgtgtgtgtgtgcgcgtgtgtttgtgtgtgtgtgcatgtgtatgtatgtgtgaaatcgctaatacagagaagctgttagaacaattttctcacttcccaaaaatgtccgttcattcatgggcctaggcaactctcctttgtgtgtcttacagcccaacactgtcatataaggtgtggttctataatgaaacagttttatctgttgtttacggagctagtcagcctgtgttatgcttgttactggttgagggtgtccaggttcttggcttcttgaacaaagaattggacaaaactcacaaatgaggcaaggaaagaatgaagcaacaaaagcggagatttattgaaaatgaaagcacactccacaggatgggagtgggcctaagtaaatgattcaaggccctggttacagaattttctggggtttcaataccgtctagaggtttcccattggttacctggtgtatgccttatgtaaatgaagagggtggagttaagttacaaagtcatttactcagtataggccttgtgttaatggagagggtgttactcctgggggttgtggcccatgtaaacggagaggatgaagtgaagtgacaaagcccttcgcattcctgccattgctgaagtgtttccactttatttagttctaggaagtcagtgtgaattggccttatgttccctgcctccagaacctgttctcctgcctcacatagacccttttttccctttgccaacttcacttcttttacagccacctcactaccaatgtgtctgtctcctaagtcaaacatcagtgattcctctgttttctctaaacccttcttatgtcttctacttctcatctctttcttggtcaaaaatctttcaaaaatgagtaagaatgcagctattcaggcaaactaaaaataacatcacagtgatatacaaaaccagtgtcatttcacaaaggaaaattatcaatactagatcctgaaaaagaaacagcgaatgaaagccatttacacaactccattgtgtaattgacacattgaatcactcataaaacaggtgctctgggtctgaatctagatcctagctagtctggtagctgaaatcatagaattatagtagagtttaggaaatcatcctcaaaggaaagattatatgttgatatcaaatgtatatttcctttctaggcccaaacctgcaccactgactgctgaaatacagcaaaagattttgcatttgccaacatcttgggactggagaaatgttcatggtatcaattttgtcagtcctgttcgaaaccaaggtaaaaaaataagcctaagttttttgttaatttgttcggaactatttattgaacagttgctctgtgtgatggatttcggggatacctagatggaatgggcatgatcccctttttacagaaatagaaaataggtggcctatgaattattctttccttttatatccatgacaaactttggtaaaaaattttcttttctactgagcttagcatttattcagtactcttctcaatatattttccaggtagctagtgacaatcagagtgatatgtaagacaaactcatttgtcctcctagtaggaaagattctagtagaagcaaagaattgtgtaccattctgcaagtggtttgttggaatctttctttgatacctgttcctgtattcccccacccccattaatttagtcattaattactacatgaacccgtaaaataaatccttaaattattttcctggtagattttttgagctgtgtaaggacctttcaattcactttacattagaatacgatatgtgatggtaagtattaacccagcttcctgagtgatggcgtgagggcggaacccaggttcatgaaaagtattcctattattgaattttaccagttattttcagaagtttgatacaatgtgagttgatttcataacatgtcctctaactgcacttgatagcaaattatcttgttatcctgagttgtagccaacaatgacttggagaatctatgcaatactcagttttattacttctaagctcattttgaagataatactacccatggctgatttgttactataaaataggtttagtatttgctgtctggaaacattctgattagtgtctcctgggaggattataaatttatagtacccaaagataaactgttgtttccctttcctaaacttttagtgataatcagtctctgccgtgtctcattttcatcacttgccctccaagctcccatctcactgaattcttgcagtgttctgaatgttgagagccccaagtgggtcttataacagccagtcagcaacatttctgtttttcatctgacaccaagggtctcgtctctttgcttttctaccagttattctgggctcttcagctctaaagaaagtataggtcctgaaatctttccctaccttctcaatttcctggggagggcttctttggaaagtgggattggaaataagataaatttgaagataattgagaaatgaatggaaagtgaaattgaagggtccatgttaagagattgcaagttatgctatcaccaaatagattttttgtgcctgagaggattaattcatagtgcatattatgtgttgactttatcattgaggtcctggcacatgatagcattggcatgatataatttgagctactgatactatagtgttgcttctggtgttgttaccagaacatctaaaatatattaggatttttttaatggcagaggaaatgaagactaatatgacatagtccttgtcctagtgatttacagtttagcaagacatacaagcaaaacattaaagtaaagcatgataactactttaataaagcattttttaaattcattggtaacataagagaaggtagaagagtttagcaaacccttcccaaaagaaatgattgacaagttatatgagataataattcagggaaaggaaattcgactttctaaagccaaattatttgacattggttttcatatagcttggtaaaagctgttattttctcccatgttctttattctttgactgttataagtatgatttgtacagagaaatggcaatttcaaaacagagggctttgatggattaattgctttgaattgatccctcatctacagtatcttgtcaggtacttgagaaaataatgtacttaaagtttcctcttttgactttcttttggtattctatactgtaagttggggaaaaaagtattttctcttcctgctaattgggctacttgaaaattcccaccaactttgccaataccagtgttctgtataacccagaattcagaattagctgcaattaagggaattcacagcttttctgtagtcagagagcaaattgaaattaaagaaaaaagaaatagtgggaggacaaatgaggttttacctttacacttgaaaacagatttaagaacaagccttatacctagatttattaatactttgaggtatgagagggaagagaagcttagaaatacggcagaatgggctttctttgttcttctcccagctatgctgtttttatttattattgtatttttaagagagaagggaagtgtctctcctgggtcacattaattaggaaatacagagtgttttcataatgcgtaaagtctagtccatttaagtcttgtttcaaaatgctatttatattatttgagcaggaaggcagagaccttaaactgctccacccaattcattttacacaaaagattaaaaagaaaaaaacagtgtcaaaaggtcaagtgcccagtgttgcacaactaatgataggcaaaacaagagaggaggggaaaaaaaagaatcctgactcccgactcctagttcagtgtgttcttcactgttagaaggtgctgctgaacatagttataccatatgaagatcacactatctatttgagattgtagaaatttgattactgcagagctctggctgggctagattcacttcttattctttattgcattgcagtattcttaagagataaatggctcttttagaatcagattggccttggctgttgaaatgaggcattaattaccttggtagctgacacattcttacaggtcaggggcttgatgaagtttatcttcttcccttgttcctgtgattgctctgtaaatagaacacattcagagcccttgaatgcacttgcagcctgtgcctcccacagtgatcgatggtcagataatgggagtttaatgaccagtactgagagagattatttccatggctgctatgggccaagaaagctgggtggtcagaaagggaccttttccagactctcctgggttgtgttatttctttgacattggtttcctttcatgaggcgccaaggtgtatttgtaagttgtccagtgttgcacagctaatgaggggcaaaacaagaaaggaggaaaaaaaaagtatcctcactcctagttcagtgtgttcttcactgttggaaggtactgctgaacacagttatatgttcagtgtacaatgtacaatgttctttgacattccgtcatttgaaggatgggtcctatggatagtatcatctgcatggttttgaaaacaaaagatataagctaattttgccctgtctagtgactacgagacagggagagaaaatctgaatatttgttaaagtagacacagacccataaattgaaaaggacactaatcctgccttaggagacagtaaggcacttgtccctgctatctattagctgtgtgtccttggacagctcattgcttctttctgagccaccgttacacgttatctatcaagtgagcaggttgtacactagatgaattcacaggaccttcttccaagtgcttttctaatcttcataatttagataatctctcagtagcaaaacagtgtacaatatggtcaatctgagatttttagggggagaattttagggaacatcagaaatggcagtagttaaaaggaaataggactcacaggctgacttctctctataacttcacatggtagaagggatgagagttctctctggagccttttgtattaggtcactaatcccaaaggccccacctcctaagaccatcacttttgggattggggttttaacatgattttagagggacataaaccttcatctcattgcattagagatatttgaaagctcagctcacgtgtattcctccacagctcacatgtattcctccatcacccaacctgatggctttgaacgttgtagacataaatcctttcatcattatcaagaatattgccaaaagcttctcagaaattatgaggggtttttttagtttctaaaatattctcaaagaaagtcccatgtactaatgtttgccttttgatgaaaaaggatggaatcttaatgattgccttaataagctcaacagtgcttgttagttgagtcttcttattgtgctgattcttataaacaacaacattcagtataaacattaatgtatgtgattcactaaggtttttgcatgattctctgtgaggcttcagatgtctcttggattatgtgtctttttttcatcgccagcatcctgtggcagctgctactcatttgcttctatgggtatgctagaagcgagaatccgtatactaaccaacaattctcagaccccaatcctaagccctcaggaggttgtgtcttgtagccagtatgctcaaggtaagtgttgcatttcagacaccatttatgagctatttacctgtgtgcagctggctgttgttggcaaaggcaaaaggatgatgcagtagagagagcgcagtgtctatagtcagaaaatctgagtgcaagtctggccctatcacttattaatggatgattgctcatggaatttactgtaccatccagcaaaatgtcaatagttactatatattgagtgagctctgcttgttacatatattgcctaacaatgctcaaaactctgagaagtagtaagtataatccctatttatgggcggggaacaggaactaagaaatttttctaataatttgaaggtctcacagcttttagcattggagtttcacttctaatcatcgtctccaaaacccaacttttattaaaactatactaacactggtttctctctgggagaattttaaaattctgtacttagggctgggcacagtggcttatgcctataaccctatcactttgggaggctgagatgggtgaatctcttgagtcctagagtttgagaccagcctgggcaacacggcgaaaccccttctctattaaaaatacaaaaaattagctgggcgtggtggtgtgtgcttgtagtcccagctattcaggaggcggaggtgtaagaatcacctgagcccaggaggtcaaggctgcagtgagccgatatcatgccactgcactccagcctgggcaaacggagtgaggccctgttatgaaaaaaaaaaaatctgtacttaggctttcagatcaggctgtatgtgatgtatgtcgaaaacacagctataattgattgagggagaaacgttaccattttaaagtttatgctttcaagcccagatttggccactaggaatttcccagctcactagtgaaactgctgatgagtgattatttgccagtgagcctttcattctttctaaaatatgtactactagttgtgacttgtaggctataggggctataatatatcaagacaatctttatcctcatgaagcttacagttaagtaagagatagagattaaataattataacaacagagtgaagaacagtgaagaaaaagtacagagttataatatatataatagggccaggactgcatgaggaaggtaggaaagacatttcggcaagaggttgtcagggaaaagacttgcttgagaaagagccaagttgtggggtctggctgcttagcaatgaccataatacctaacttttgctatttttacatgaagtaactaatttaaccctatgaggaaagtactactaccatctagattttacaggtaagtaagcagagatacagagaagttaaactcttcacacggctttggctttaaacctatataggcttcagagcctccccacttaaccactttgccatagctacatccatattaggtgctaagtagatatctgttaagtagaaggaggatgaaaggatagttagctagttggaaaatggatggatgaatgaagtgatgcttaagctaagaacaactttcaggggtaacatgcaaagaataatggagcaaagaagaaaaaatagaaaatgggataatcctttttctactaaggggtaaccatgtgtgttattcatcttcaggctgtgaaggcggcttcccataccttattgcaggaaagtacgcccaagattttgggctggtggaagaagcttgcttcccctacacaggcactgattctccatgcaaaatgaaggaagactgctttcgttattactcctctgagtaccactatgtaggaggtttctatggaggctgcaatgaagccctgatgaagcttgagttggtccatcatgggcccatggcagttgcttttgaagtatatgatgacttcctccactacaaaaaggggatctaccaccacactggtctaagagaccctttcaacccctttgagctgactaatcatgctgttctgcttgtgggctatggcactgactcagcctctgggatggattactggattgttaaaaacagctggggcaccggctggggtgagaatggctacttccggatccgcagaggaactgatgagtgtgcaattgagagcatagcagtggcagccacaccaattcctaaattgtagggtatgccttccagtatttcataatgatctgcatcagttgtaaaggggaattggtatattcacagactgtagactttcagcagcaatctcagaagcttacaaatagatttccatgaagatatttgtcttcagaattaaaactgcccttaattttaatatacctttcaatcggccactggccatttttttctaagtattcaattaagtgggaattttctggaagatggtcagctatgaagtaatagagtttgcttaatcatttgtaattcaaacatgctatattttttaaaatcaatgtgaaaacatagacttatttttaaattgtaccaatcacaagaaaataatggcaataattatcaaaacttttaaaatagatgctcatatttttaaaataaagttttaaaaataactgcattatggagtttatgtttacttcagggaatttttatcactgactcagtaagattcacttatgttacctatgtaagcatttatttaagaaggaaaagcatttgaagatatttcaattaaaaacaaaactatgaacctttatgacagggagatatactcagataatgcctagtgaatcctaaaattatccttggatgtttgatgagtctgagacctcagagaaaagaaataagagttttgacaaaatctggatattggtgaatttattttctatggtgtgtatcttgtatttgggagtattggttagtcttcagtaggtgagcaataatagcttaatgagtgaaatactagcagcttagatttaaatagatttttggaatctcccagagatatttcacagtggatatgaaacctctatgctaagtaacatatgccttctcttagaaattatgtaacaggagaataaggcagtcagagctctgaaacataaacacggaccacagccttttcaagctggaaaggaccataaagatcatgtaatttaaactctttgcacagatagagactcaacttagagggcaagagatgtgtccaagttcacacagctggcaagtgatggagtcatgcttaaaacttagatcttcgaaaccgagttctctttgagcaccttcgagcactgaatctcagcatttcccaccagagtatctgcaatcaccagggatactagctgcatgcttggaaatttcaccttaacattctgagtttcagagttttgtgcaaaacccacgtattttctgcattaaaattcactataatgatgtttttaccctccttgaactgcagtagggctccaggagtatgcaccatttaaagtttggcttcctggacctcctggcatgctgccacatacctttgatcttttcaccacatggtggcacagaaacagcactggaaggcatagccagggtcggaatcattggaaggcctccaaggagatgagatacattttctttttattgttactgattgaatgtaatttccatcctattttgtgcccagcctcactgctatgtgaacatataaacagacctttgaaatcaagcataagttttttttcactaaaattcatgaagatactatctgtcagtttaacaaacacaattctatttaacatgtaagcatgaatttattctctagttttccagttggacagcagtcggctgacacatgagaacaactcatcatgatgtagagtgcctgtgattttgcactatttcatgagggccctgactggctcttaagtaaattcattgctggtgtcattcattaaatactttaggaaatattaaatggctaaatactggtgtgaacctaactggcatggaagtcagattatacaacatgtttgcttgaggacaagcaatgatttgaagaggccctaagttttcagagattatgagggattgcccagaataagaacttaagatagactacatttcaacttggatttatctactgtcgaagtctgcttttcctgtttctgtatgacagaaagatcatttatatcatccatgttgcagatttcatcaaatacagtgactaaatggaacattagggttccacaaaccatgcgattagactgttaagctgtacaaaaagcagttggtgtcagtatctagaactttttatattgatgctaatagaacacatactcggagtcttttaacaaatggagctctagaaaaaaaaatcagatgggaactctggctaacctccccaaagacattcccagaaaatctacaaggattatctacataaatgatgccacaggtcacaaagaagaaaaataatatttagctgggcagtctaacacaagcataatattgactctggagctgtagtgcctggataagagttttgactctgtatcttattagccatgaaaccttaggcagtttccttatctacctatgcactgtgcatcctttctttctttctttctttctttctttctttctttctttctttctttctttctttttctttctttcatctctctctctccttccttcctccttcctccttccctccctccctccctcttcttttcttgtctttctttactttcttttcttttttcttttccttccttttccttccttcttccttcttccttccttcttcctccttccttccttccttctccttccttccttcttccttctccttccttcctttttccttctccttccttcttccttctccttccttcttccttctccttccttccttccttttcttttctttcttttctgtaaaagtagagaaaatggcatagatatctctctcactgtccgaatttctgactttttttttgagtcatgctcactgcagcctcaacctcttgggaccaagccatcctcccacctcagcctcctgtgtacctgggaccacaggtgcatgccaccatacccagctaatgaatttgtcctctctgaaccattaccattgcaacaaaggaactaaatgtatttgtatttgcatttttaacagcattacttgctatctaaactcaggcccttcatcattccaaatggaggtgctaaagataattaaagacaatgcagtttccctgatcataaaaacttgctcacagaactcaggaactgaatagatttggatagtaaggaatatgtatacatatttcatagagttctctgagggttaaatgccatatatatatatatatatgaagtatatagaacagtgcttagcatatggtaaggagtaaataaatattatctttttctgaactcaaattgtaaaataatattttgctatgaggaatcagataagatgtattctataaataagctctatgacaagaggatagagaagggcttatgaggggttttttgtttgtttttttaagggcgaaaagaacctacagaggaacactagcacaaggaaacccacagagaaaagcaaaaagctttatgagttaggcatatggttttaattttattttttactataaaatttttttatccctcactaccaccattcttgtgttgctgcctgtgggaagagaacaagtctgagaggtgatggagtttgagagactaccacagggatgagtaacaggacccagccagggaaaagacattgcaactttgaagtgaaaaagactgaaggtaatgtaaagtcataataatttgattttcctattcaggttctaaaagcatgaagataaagtaagcataacagattcacatcacattaatgctggaaggttatctagtccacctcttgctaaaaatgggccttgagaggtgaagtaacatgcctgagcttccagctaataaagataaatctatgcttcaatatgtccagaactttctattgtacctgctgccttccaattaagaaaaatggcaaaataatgtttccattcttaaatgttgtgagaccagtaacctcaccttgttctttaaaatcatttccaagatttgtgccacctcccagaaatcctgttctcatttctttggggcaggtactctgagtgccaatccatgtgtggtggtttggaaggattaatataacagttttcttctaaatatagtgatgttaatatagttatatctcttaactctaatgaaggtttatttttggtttaaagctaagtagaatcttcctgaccaagtttggggagctttagatatatcagaatcttctttgatgggcagcacatggacttagaattgtgtattggtagtgggtcagttagtcactgggcctaatgaaatattaactgtaaagtattgacctcattgaattttagttccgattaaaagtgcaaatttgcgtgaaattgcctgggacataaaataattggaacttcagcagactttctggtcatgccatactatgtcctcctagtgataggaaactggaaattcaggagataaactaactcaggcagaaaatgcagcacatgccttttgtgtgtgtgtttttcctttttcctttgagaagtccatttttcaatatcccttttctttaaatctcttttaagagttagtagaagaaatttaacctcttcttttccaactttgaggatgtgatgctgatgtaatactttggtttttaactttatgttcttaaagacaatttgtcttcttgaaattcaagtctgtaggtggttaaatggggaaagaatgtgataaacttcagactccccaagttgagaaaaaaatagcagacttctttcttcctctaatgcaaaaggtcttaaagagattgaaatcctagcaatcaattgaaagaaataagttagagaaatagctttctcctgaggaaatgagggaaacgccataaaactaagcgttgtgcattaaagtaatcattgagatgattttttttttctgtaatgtattttctggaccttcaaaagtattgaatagtttcactgtagtttaagataaatgacagaaaataagtgcttttagtatcagatttttataccttcattctctctttttgggggtttctgaagaactaaaagtctgcttttcttttagattgactatttctatgccactataagaaatgggcactattcccaagagatagcaggtgcaatcctagttcagcaggctaaaattcagttgggtgagaaggataagcctatggaaagaaagtaaacaaaacagcattgtgccactagagaacccagaaataaattcatagattttcagccaactgacaaaggtgccaagaacatacactaggaaaagaacaccctcttcaataaatggtgctggggaaactggatatccatgatgtggaggagaatgaaactagatccttatgactcaccatataccaaagtcaactcaacatgaattaaagacttaaatgtaagacctgaaactatacaaatactagaagaaaacataggaaatgcccaagaactttagcttaggcgaagattttatggttaatatttcaaaagcataggcacacaaaacaaaaagtatacaaatggagctatagtaaactaaaaagcttctgcacggcaaaggtaacaaccgacaaagggaagagacaacctgtagaatgggagaaaatatttgcaaatgattcattcgacaagggactaatatctggaatataaaaggagctcagacaactcaccatcaaaaaacaaaaacaaacgtacaaaaaacccaaacaatctccttaaaatgtgagcaaagtatctaaacagacgtttctcaaaagaagacatacaaatggctagtaggtatatgaagaaatgctcaacatcgctaatgattagggaaatgaaaatcacaatgagacatcattccagttagaatggctattataaaaaagacgaaaagtaaaaagacacttgtgaaaatgtggagaagagggaactcttatgcactcttggtggtaatgtaaattagcacagctattatggaaaacaatatggaagtttctcaaaaaactaagaatagaactaccacatgatccagaaattctaccaatgggtatttatccaaagaaaaatcagtatatcaaaaggatatctgcattcccatgtttattgcagcactcttcacaatagtcaagatatggaattaagtcagctgtccatcaatggatgaataaagaaaacatggtatatatacacactatggaatgctattgggccataaaatagaatgaaatcctgcaatttgcagcaacattgatggaacctgtggttattatattaagtgaaataagccaagcacagaaaaacaaatattgcatgttctcactcatatgtgggaggtaaaacagtggatcccatggaggtagagagtaggataatggttaacagaggctggaagggtattgggggagaggataaagagatgttggttaatgggtacaagcattcagttgaaaggaataagttctagtgtttgatagcacagtagggtaactatatttaataataatatattgtatgtttcaaaacaactaggagagaagatatgaaatgttcccaacacagaaatgataaatgttataggttatgtatatgctaaatacctagatttgattgtgacacattttatgcatgtatcaaaataccgtatgtacccccataaatatgcacaaatgtgtaccaatttttaaaaatagcattgtggcacaaaaatgtcatggtctttggaaccagaaaatcctgatattgagtctttgctccaccaatgtttgttatttggactttgttcagttattgaacagagatttctagtagtcagtgtctttgcctgttaaacagcattgctaatatcttttttcaagggctgtgccaaggtttaaaagaagcaacgagtgtttacatataacttgccttgttttaaaaaaagatttaaagtgttttgcaaaggttaagacgcaatgtaaaataaattaaaaataagtgagtgaactgaattaaagggaagataaacgtaggaaagtaggatatacccatgaaataaaagctatataatctagtacattacctgatacatggggatcattcttcaacgctggttctcaactagaggtaattttgcccctaatgttggtagacatttggggttgtcataactggggcgaggatgggagtgtgctactgcacctagttgatagaggccagatatacagctaaatattctatagtgcacaggacaagcctccacatgaagaattaaccagcccaaaatgtcaatagtcctgaggttgaaaaagtcctgtctacaacatgctaattcctttatatactttcccagcaccaaatgaatgttatatactttggaagagggaaagaattctgagggttgaagtaatcccagaagcttccaaagagaatctggaacttgagctgagctttgaaaaagcaagaggcgtagtaaaaggcatgggaggccaagagactgtgggaagatagaagcaatgagagaagattaagacacttcccttcaatttcaaggtgacagattgaccccattctgcagtaatccccacccaacagaacctactgacatgactataaaaggtataaaatgtattaaatacatggccacaatttataagaatagaatgtcttaatgaaccagaagttgtgataaacccttataagaaaaagtgaggggagcaaatgggaagttattgtgataattgaaggcccaagcatgtgggaaaattctgccatagaagatgaaaccattcaactcacccaacatttcatcaaaataaagatgagaaggaaagaggtagattgtaacatctttacttaaagcattgatccttcatgcctgctgggtcatgagctgctttgagactgctgaaaactatggatactttctccagaaaagttcacttacttatcccatatttgcataaaattccattaggcttatgaagatgtgtaagccccagtactggcagtaaacttttatgtgtatgggtgcctcttcccctaggcagtagccattccaaaatgccaatattgttactatttaaaattttctttcagttataggctgggaggaaccattgaaaaggcttggcaggtgagattcaggtggctagaccggttaggtaactcagctttgagccataatctcatccggggtcagacctgttgggaaactgagctctccatttgttccctgacccttagtggctctctcagtcctcagccctttgtctgtttctctggggtggagatgtagtcttactcatgctatcattgtctctagagccaagactctgaccagtaaaatcccacctgggaactagattccttctgccaatggagagactttttaaaatgctcactacatgctgtcaagaattgggcattttgtgcagcacctggattccccatcattgtgctcctgctacacccaggagcaaacattatcttccccctgcccctccccttgaacctgactgctgcctctttataccttgactgtcccctgcagcagcttcaccaagtggatactttatttttgacccagttagttttgcctttattggtaataataatgatagctgccatttatcaaggtcttactttgtgctaggtggtatggtaagctctttgcatacaacgtctcattgaattcctggtatagattttgttttacacataaggaataagacaagcgaaggaagtcatccattttcttgggatttgaatccaggtctctgttctagcaccatagctcttaaccatacttccctcaagatgttcttcctgtgcttttcccaggagtttgttgatatttcaggtcctgatctcttttgttcttccttatcttttgtaagaaactatcgtaattgcacaagtcctgagaaataagaagacaccttcagcatcttaaactagaataaataaaagaagggtggcctcctagaatttaagtcaggagggaggtggtgggcaatggatgacaagctctactttgaagaggttgaatttcagctgaccactactaaagcagtacaagcttttcctttcagcaagtgtcttcccagaaatgtgatagcaatttttaggaagaatttggcaaacataatgtttagcagatttgcaacaaatgctataagctcaaattttttttttttttttttttggcagcacactcagccctccaaggggaagtggattatttttcttgcaagtgcattagcaagggaggtattaaggacagcaacattccttcctgtataaaaaaataaataaataaaagaagaaagattattgaggccctctctgctgtatgtaatgtacttcaggatgttggtagaaagatatcaacctagaataagttcacagaatacatttggtttcacagaaagtttaaagtcaatctggacattcagtgatctctttctgtatatttgatctacccatctgctgggcttttgaagttttcaataataaaaaataaaaaaaggaatagtcccagcagtatttgcatgaacttttattgaattcagttcagagccctttggcatgaagagtactgactttggcaaacatccaggaaacactcttatgggaagcttctctgtttttgttttggagcaactttgcacaattaatcacagcatcatttacagttataaaaagttggaaacaacctagaggcccaataagtagaaaatagatcatttatagtacacaaacttgacaatatattatacaatattaaaaacaacaatggcactaacataacaacattaagaagtacttatgttatatgtgggaaaaatgatgctgtattttgttatgaaaaatgcaaatggatatgttagtgccttcaaaagggcaagaggattatgaatgattaagcgtacttatttcctttattgtttttcttatgaaaaatagctatggtataaataacagaaaatgtaataaaaatttgcatgaccaaagaggccttatcacataaataagctcaagtctctctctcctccaaaaagccactataagagcctgttctcacactggtgtgaagatggagtaatttttaaagaaaagaggtgtaattgacaacagttccacgtggctggggaggcctggggaaacttagaatcatggcataaggtacctcttcacaggacggcagaagagagaatgagtgcagagcaaagggggaagcaccttataaagccatcagatgtcaggagaagtcactcactatcatgagaacaatatgggggaaactgcccccatgatttacttatcgccacttcgtcccacccttgacacatggggattattacaattcaaggtgagatttgggtggggacgcagaggcaaaccatatcagctaccaacttttcacctactgcaaatatcacattatacttttcttaacatttaagtgtcttcaacgaaatttcttttaccttctcactttgtgttttctcctcagtctgttgaaatctgccttctgccaggtcacttaatgtgaaattgttcacatcaagataaaatccaccttgttgctgaaaatagttttcagtctttcagcagttggtatttatttggtcacaccttctttaaccttgcaattcccagatttcagatctgtatttctttgcaatattcttttcaggctcccggtcctccttaaactttactttccctctaggcatgtgagctcccttaaataatcaggcccagaaaagcatttaacatgtggcaacagtcacatctcactccctcttgagctaaatcactatctctccaagccacttgctttgcaggctctagactaactgatcccaagtagccataaaatgccatataccctatagttccacaatgtatagccaattgctaactaatgttatttctgtgaaccaatgagaattcttgacaaaaaaattttgtaattgttgcttcccctgattcatcttttttttctttaaacacttgagcatctgttttgttctccagagcactcccaaggcaatttggaagtgtttcctgggctgcagtccttaacctttgtgcttgaataaactctcttaaaatagactttgaatttgtttattttatgttgacagtttcttggtgtctgttgaccagatgccactctcaggaccttgccatgtgggcctctataacacaacagtttgcttcattaaaatgtgcaagctatgaaagcaacagagagagtgtacttgcaagacaggattcataatctcttgtaacctaatcatgaaagagacatctcctcaatgtttccatattctgttggtcagaagcacattactgaaggagatagtgttacatgaagcctgaatataccaggaggtaacttcactgggggtcctcataaaggctgcctattataattctaaaccctgtatctcattctccactgatacaaggcacaagtcctattactaaatgcaacatgcacaagtctgaatacatcatctttctattcccaaaggcagctcatttccatctttttagttaatggcatctccattcaccaacttttcaaaaatcagaaaactatcgtatttattcatcttccttaccccaacattcaattaatcatgagctgctattaattctgatttctaaatacctattacatctgtctctccacatgtctgtcttaacctatcatgatctgtaacctatgtcatcgctatggcttcctaacataccttcctactcccagtcttgctctcttccagtccttaccacaccagtggtgacaatgccacattcctgcttaaaatgctcacctggtttcccatagctcaaaaatatttcaagatggatatggatagtgattctgaaaatgcacattcaataaatctgtgatttccacaatacaggctacaaaaatttaaactcaggaaaatcttagctggtaagaatatgtgaagttgagtgacagttgtgaacaatctagctttctatttgaataatatgcaaaatccctatataagttgtttagtgtggaatctcagatatgggggatgtaaactcaaaacagttgtattagttttcagtaaccactatcaattgttctttgaacattatctatttggaaggctgtatcccttgaagatatttcagttccactctataactttccagacattttcacatattagaagtttcatggcagttctgagaaactcagacctatttattgtaatatttcaatctccaagggcttctgctagctcacagagtgccaatatgggaatgggaaaatgatgccccttcctcctggtggagacagggacctgcacaatcagttcagaccactaattcctccccagaccgtgtgaaattctagccgcctggaatttagagattgtgtggcctgctttaacaaacttcctcttcgtttttctaatctggccatggaataggtgtaaataagagtgaaaatggtattttctagtcagttgtaacatgactggttatcaaatatttcaaatattgccccaaatactacccccagaaggtggtgctgtgagttctgaaatgtttgtttgggagctgtctctccagaagcagacctggatggaccaagtacaaactagaggtcagttatttgtgtttatttcaatctgtgctgtccatgacttcaaagcacaagtcactggattctctaaaaatacttcccatcctcaaattctttttaactggatcaatttttgaggcttgggagacagttgaaagttgttattctgacagctccattcaaaaatgagatgtaaaaaatgacctttttataggaacatacgggaaagaactataaaaacgcttaagatttggtttggcagagatatttttctcattcaaaaatgagtagcgtttttggcacttgctgtggtactttgtagctggcagctgaattattttggcctctgcccaaatctctggactcaaaagctgatcttcaaatctcctgtttagttaaagaaggatttaaaacacttaatggccatttacatgtcaaaaataagacattatattaacctgatattgagacactgtgcctgtctaaatagcgatgacaatagataaaataactaccttttgaatggcagtgcattacttgtattattcttcaaaacaatctgtcaatagaacaggttttaaaagcccattttacagataggaaaactgaggttcagtagaccaagatccttgctcagggtatttggaagaatcagtattcgagcccatggctacagacatttacctattctctattatgtcacgttattttcaatgtatattttctgaaatgcaatgcagtaggccttgagttagtaattcttcctttaaatgtacctgcaaattatacaacactcttagccaataatgacttagagaattatttctgctttctttagcattagtacttttatattcttcttaaaggtaattattctacctatgactgggctattatgaaacagggtggtcttggtagtttacaaatatgtccataagtagatgtatcatggtgccctaaattagctttactcatgttcttttctttctagaaaatttttgttaaccaggatcccatgcctctgtaaattgaccatcccctaacccatagcttcatatcatttagtgttctgggacctccaaatgaagtctttattattagacaaggaggcatggtctgtctgatatatgttgaaagccaataacataactcactgtctttcaatttgataataattctgtcttaattcagtcttatacatattgcttcctattatcttccattctttttcttggagaaagtaaaatggaagagccaaatgaaacacagtgttctaaatctacccatatgaagtaatctaccacttcagatgtaagttggtatagaataaaaggaagtcacagttcaatttatggattccagggaaatacagtagtatgatccaggaagtatagatatttaaaggaggcatcttctaagttgatggaacatagctgctgaagtttctggggcacaaatagggacagtaacatgattctaaattttggctaaagattcccagtgagttagtgcctgggtgaggtaggtgggcatagtgtatcatgatccagcaaagtaatagctgagcatggtatctagacccaggaaaatgaggcaggggtcgatgggggaactagaatacaaactaggaggatattcaaggttctgggaaggaagaaagtctgcaactttgcatctgggtttatttccatatacaatgaattttaataataaatgctggtgaggatgtaatcagtggggagaaggaatttgtacagagaaatattatgatcagatctttgcttttgtaatgttgttatctgttggtaaggaaatcataagaggaagagcaagattggcaacagtgagatcagttaggaagctattggtatcttcaaagcactgtccaagtctcaccttcatcctcgtcagactttctcacccaaatttctgtaggataaactacccttgccaaatcatttaacatttattttctgtttctgtatcatacctttctaatgacattataaactatgatgaatttaattttattttagttgtttcattgcattaggttcataataaacacacagaaaaatacatgagtgcttttcaatgaaaagtagaaagtaggagcaaataaagcatcgcataagtagagaaaggaaggcataacatattatgtacagggatatagatatgtcaaaaaggggaaagctaactgattcctacagcaaagtattagatgggtgacttttttttttaatgtgtatatatatttttttttttactattttttttctaacttttaagtgcaggggtacatgtgcaggtttgttacgtgggtaaacttgtatcatggggtttgttgtacagattatttcatcacccaggtattaagcctagtacctattagttattttttcccgatcctcttccctccgccttccattagaccccagaaagtgttgttcccctctatgtgtccatgtgttctcatcatttatcttccacttataagcaagaccatgcaatatttggttttctgttcctgcattggtttgctaaggataatggcctccagcttcatccatccccctcaaaggacatgatctcattcttttttatagctgcatagtattccatggtgcatatggaccacatttactttatctattttatcactgatgggaattgaggttgattccatgtctttgatgttgtgaatagtgctgcagtgaacatatgtatgcatgtgtctttataatagaacaatttgtattcctttgggtatatacccattaatgagattatttatataaatttaaagggtacaactgcaatttcgttacatggatatattgcacagtggtgaagtctgggattttactgtatccgtgacccaaattatgtacattgtacccattacccattaagtaaattctctctctttctctctctctctctctttctctctgtctttctctgagccagggtctcagtgtcacacaggctagaatgcaatggcatgaacatctctgcagcctcgagctcctgggctcaaatgatcctcccatctcagcctcctgagtagatgggactacaggcccatgctatcacacctggctaatttttgtattttttgttgaggcaatgtctcactatgttgcccaggctggttttgaactcctggccttaagcaatcctccaccttggcctcccaaagtgctgggactacaggggtgggctgccgtacccagcctggatttgttttcctttgggtagatagctagtagtggaattgctggattaaatgatacttctattagaaaataacaggctcgctcttattgtttcgaatgtattacttatagatgcaggctctgaggctttgaagaaatccagaacataaaattaaattactaaataatacaaggaatcaaagagaacatgagttatttaaaagtgttcaaaagaatatccatgttgtcaggagctgaatttatttaaacacaatatatcagaataaaattttttggtcactaaagaatgcatgaatatgtatgtgtatatatatatatttgtgtctacatatttatgtgtatatgtacatgtgtatgtatatatgtgtgtgtgtttagaagagtgagagagagagagaagagaaattgagaagtgaaggccaatcgccacaaaaaaatttaagtttttgtcatcaacttgcaaatggaaactggcactgtgctggaataaagatgagactttttttttctttgtttttgattaggctttcttccagttgcaattgttagaatgtagaatttgcagcacatggttactttttttgaatgcccgtgctttggagatatttaaactcagacctcatgtatcacttgcaatctgatcgtgcaaatactgaatacctgactgatctctttatgagcccaaggctgttttatcccaaggcttggcatgctgtcagtaactgaaaagtccttagtcctgccattaagctagattttgtttcataaaagaaaagagggagaattatgctttctgaaaaaaatagcatgtaggttaactttggtctgaaccctttaaaatcatcaaatggtttcagggttgttatatatttatctgagttattttgaaccacatatatctctaattgcttggcacatgattgtttttgctcctaatttcactagcaatactgagagatggtaatcttcataccacaaagtattccctattttatcatctgagtgatctttatgaaaaccaagtctgtctaaaattatttctaaaactgcattagtttaaacctttaagagattactattgtgtttaagttaaaattcaacctgagaagttggtgtaacatagaagttaagagcactagcccttgagtcagactggctcgcttcaaggttctactttatactaacccatctgtatttcaggttctgggttctgaaaactgaggaaaatgatagcacataccacatacagttgttaagagtatcaaatgagataatttacctaaggccattcaaaaagtgcctggcacacagtaagtgtttaatgaatgctaaatcatatcatcattgacacaggaggcaagccctttatagttgggtctttaattgatttgtaatttcctatgtgtcaataactctgttggatttctccatatatgattttgtccaatttatacaacaatcctattggataggtattattatccctgttttcaggcatccaaagtaggtacttaatgttcccaccaccatcgtaatcatattcttattcaataggtgttatcagttcaattcaatagagagagtagtcccttcatatgagcctgagtaatttaaatataggatgtcaatctgtggagaggggtagcggggggagagagagagaagggatgggatgggaagggaaaggaaggggagggaaggggaggcagacacacacagagagagagagagagaagaggagtgggcaagatctgttaacagaagcagacataagaaatggggcattgagttctctatacctggctctgttatctttttgagacacagcagcactgaattttttctaaattttccatgtattcttataatgcaattaccattttggctaaaggtatatttccttgaaaattgaaaatcctcactgctgctttactgctggtagctatataggagaatacagaggattaaactctataattctctctcagagattatatgatgcatgggctttgagcaaaggaataaggtgtgttgtgggtaggacaagagacagagctgccagttctgtgtaccaaagagtaaagggacagcctattctgaacctcaagagatcctattcatcttttcctcaattcaatagatgtctggtcactttaaattttcacatctagaggttgctactgagaggactctacctataatagcaaaaatttatgtgaagtggacctgtagcctccactcataacatgaatttttaattctatttacctggatattttgctgcatgactaattcatatgcctggtaggtgggcagcatgttgcctatgagctaaattgctgagatgaatacacagaattgataagttctcagacagaatcataataatgctagaacatgcccaggctacccagcaccctgaggctgttcttgaggtcagcagggatcatgaacataataactataattccggttattattgccattctcacattcttatccaccaatttccattacaaactctttgttctgcttggtcccacacaaagtgttctcaaattttatgtcaggaaaagagttaaggtctagacttctttatggaaagtcatattcaaaactggacattggcttcttaaatacttgttggtggctcaaaatgaagtgatgctcttttgtttttttttctttcctctcatttaattttttctctttcattattctattcctctttctgtgtgtacgtgtgtgtgtgtgtgtgtatgttttcaataaaaaattaagacacagtaaatgttttctcaactgattgttagcctatttgtatctctgtaattaaatacctcattcttttcagtatcacagtgtttaagtctaagatttttcacattcaaaattgaaaagtttaattaattttattcatttaaagtgtttggcccatcctcatggggatgttctgattttcttactttaaaaattgatatggagagataatgtttaactaattgcatgtttatgaaatacacaattggataagttctgtcagatgtgtacactcatgaaaccatcaccatagtaaagacaatgcacatatagattgtccacaaaagtttacttatgctcctttgtaacctttctctccggctgctctctgcctgcacccctctcccattaggaaacagctgatttactttttgttgctataaattaatttgcattttctagacttttatgtccatggaatacatacatttatgtcctctctattgtctgagttctttcatttggtataattatttagagatttatcaatgttataatgtgttaataatttacatcttttttttttttttgtgagatggagtctcactctttcccccagactggagtacagtggcacaatcttggctcactgaaagctccgccttccgggttcatgccattctcctgcctcagcctcccgagtagctgggactacaggtgcccgccagctaactttttgtatttttagtagagacagggtttcaccatgttagccaggatggtcttgatctcttgatccacccacctcagcctcccaaagtgctgggattacagacttgagccactgcacccagccaataatttataccttttattgctgcgtaatattccatttatggatatatcacagattctcattcactgttgatggatatttgggttgtttcaagttttgcgcagtataaataaagcttctaggacattcatatatgagtctttgagtgacatatgcttcatttctcttgaatagaacccgaagagtgaatgattagaccacatagtaggtatatgtttaacttgtaactgccaaattatctttcaaagtggttgtaccattttatacttccagcctcgatgcataaaagttccatttccttgacatgcttgccaattggttggtctttttttattttaacccatgtaatagctatattgcaatatctcattttttgttttaatttgcatttttaacatgactaatgatgtttagtactttgttgtgtatatatttgtcaccactatgtcttatttggtgaagtgtctgttcaaatattttgctgattacattttttattattaaatttttaggttttattattgagttttatatattctggatacaagtcctttacagatacatgatttgatatattttctcccagaccgttgctatgtattgtaattcttttaacaatgtcttctaaagagcagaaggtattaattttgatgaaatacaaattatcagtttgttctcttgtggatcgtgcttcatatgtcataactaagaaattaattgttaaccaatataataaaggttttcttatttttttctaaattatctatgctcttaggttttacttttagattcaaatatattttgagttactttttaaaaaatacactgtgaagtatggaccaaagtcattgtttgtatatggatattcaattattccaccaccatttgttgaaaagacaatccttttcccactgaattaccattgcacttatgttgaaaatcaattgtccatcaaaatcagttatgcagaccagtttctgaaggttctattcttttccatttatctatttgtctatcttgttgccagtgccataattgtatagattaaaaacataattgtaaactgtagccatataatatttcttgaaggttagtcccccaactttgttctttttttctttttaaaaaaattttttatggatacatagtaggtatatatatttatggggtgcatgaaatatgttgatgcagacatacaatgcataacaatcacatcagggtaaatggggtattcatcatctcaagtaattatcttttctttatgttataaacattccagttatactctgagttatttttaaaggtacaataaattatcattgacaatagtcaccctgttgtgctatcaagtactagaacttactcattctaactatatttttgtacctattaaccatccccactttcctacccccacacactactcttctcagcctctggtaaccatcattatactctctgtctccatggcttcacttgttttaatttttagctcccacaaataagtgagactatgcaaagtttatctttctgtgcctggcttattttacttaacataatgttcttgagttacagccatgttgttacaaatgacaggatctcattcttctttatggctgaatggtactccattgtgtatccattcttctgttgatcaacccttaggctgcttccaaatctgggctattgtgaatcgtgctgcaataaacataggagtgcagatatttcttcaacatactaatttcatttccgtaggataaatacacagtagtgggattgcaggatcatatcagagtttttagttatttgtggaacctccatattattctttatagtggatgtactgatttacatccccaccaacactgtataagggtccccttctttccacatttttgcaaaacattcattattacctgtcttggataaaagccacttgtactggggtgaaatgatatctcattgtagttttgatttgcatttctcggatgatcagtggtgttgattacctttttatatgcttgtttgccatttgtatgtcttttgagaaatgtctattcaaatattttgcccgttttttaattggattattagattttttttttttttttttttttgctattgagttgtttgagcaccttttatattctggttattaatcctttgtctgatagatagttttaaaacatattctcacattctgcgggttgtctcttcaccttgttgattgtttcctttgctatgtagaagacatttaacttgatgtaatcccatttctccatttttgcattggttgcctgggtttgcaggacattattcaagaaatctttgttcagaaaaatgtcctgaagagttttctcaatgtttaattttagtagttttatagttggaggtcttaaacttaagtctttaatccattttgatttgatttttaaatatggtgagagataggtgtctagtttcattcttctgcatatggatgtccagttttcccagtaaaatgtattgaagagactgtcctttcctcaacgtatatccttaaaatctttgccaaaaattagctcactgatacatggatttctcagttctttattctgttccattggtctctgtgtctatttttatgccagtaacatgctgatttggttactatagctctgtagtgtaatttaaagtcaggtaatatgattcttccagttttgttctttttgctttggatgtctttcgctactctaggttttttgtagttccatataaattttaggatttttttttctatttctatgaataacgtcactggtgttttgataggaattgcattgaatctatagattgttagggtagtatagacattttaacaatattgattcttccaacccatgaacataaatatctttctatttttggtgtcattttcaatttcttgcatcaatgttttctggttttccttgtagaggtctttcatatctggttaaatttattcctaggtatcttatttttttgtagctactgtaaatgggattgctttcttgatttctttttcagattattcattgttgatatgtaaaaacgtgactggtttttgtatgttgattttgtatactgcagttttcctgaatttgtttatcagttctaatagtttttttggtggagtcttttttccattttattatctgcaaacaaggataatttgactccttcctttccaatttggatgccctttatttctttctcttgtatgatttttctagctaggacttccagtacgatattgaataaagtggtgaaagtgaacattctgtcttattccaaattttagaggaaaggctttcagtttttccttgttctggatgatactatctgtggatctgtcatatatggcttttattgtgttgaggtatgtttcttctatagtcagttttttttttatttttatgatgcagagctgttgaattttatcaaatgttttttgagcatcaattgaaaggatcatatgatttttgcccttcattttgttgatatgatatatcacatggatttatttgtgtatgttaaaccatccttgcatcactgggataaatcccacttggtcacgatgaataatctttttaatgtgtgactgaatttggtttgcaagtattttgttgaagatttttacatcaatatttatcggtgatattggcctgtattttttagatatatctttgtttttattatcacggtaatagtgaccttgtagaatgggtttggaagtattcccttctcctctatttttcagaatagtttgagtagaaatggtactatttcattaaatatttggtaaaattcatcagtgaagccatcaggtcccaggattttctttgctgggagattttcattacagcttcaatctgattactttttattggtctgttcaggttttggatttcttcacagttcaatcttggcagggggtatgtatctacatttcatccagattttctaatttattgcatatagccacttatagtagtctattaatcctgtgaatttctgctgtagcgattgtaatgtctccttattcaagattttatttattttggtcttctttccttttttcttagtctggctaaagatttgtttatttttttaatcttttcaaaaactcaagtttatgtttcattaatcttttgtattttttcattccaatttcatttatttctgctctgatcttaattatttcttttattctactaatttttgggtttggtttgttattacttttctagttctttaagatgcattattaggtggtttatttgaagttgttctttttttttttgacatgatgcttattatgataaagtttcctcttagtattgcttttgctgtgtcctataggttttggtatgttgtgtttctattttcatttgtttcaagacatttttaaattttcttcttactttcttcattgacttactggtcattcaggagcattaattttggtggaagtttaatttccagtttgtatagtttccaaagttcctcttgttattgatttccagtttcattccattgtggtcagagaagatacttcttagaacttcaagttttttcagttttttgagacttgcttttaggcttaacatgatttatgcttgagagtgacccattgacccatgtgctgaagagaagaatgtgtattctgcagccactggatgaaatgttttataaatatctattaggtccatttgttctatagtgtaggttaagtctgatatttctttgttgatttcctgtccagaaagtggagtttctccagctattattgtattgaggtttatctccctctttagttctaataatatttgctttatatatcatcatgcagcagtgtttggcatatatctatttacaatagttatatatcctcttaccgaataaacttctttatcactatataaagactattgttttctctttttatagtttttgtcttgaaatctattttgtcttataagtatagctacttctgctattttatggttttcattggtatggaatatctttttccatccctttagtttcagtctatatgtacctttataggtgagttgtctttcttgtaggcaaaaattcaatgggtcttctctttttcatccattcagccactctatgtctttgattggagggtttagtccatttatattcaatgtgatttctgataagtaagtaattctgtcattttgttattagttttctggtcttctcttccttctttccttcctgtcctacttttggtgaaggtgattttccctggtgctgtgtttaattgccttttattttttgtgtatctgtattttttttatttgaagttactatgagacttgcatataacatcttgtaactcattattttaaactgatgacaacttaatactgattacaaaaacaagcaaagagaaaactaataacagttctgcactttaacttcattccctccctcactttttaactttttattgttttcatttaaacttactatactatctttctcttgaaaagttattttagttattatttttgatagtttcatctagtctttctactgaaggtatgagtggtgtgtagtaatctctcaaggtgtgagaagtgtgctattataatattataatagtattataatattctgtgtttatctacgtacttactgttaccagtgagttctatgccttaaaatgatttgttattgctcattaacatgcttttctttcatattgaggaattccctttacaggtgttgataaaattcctcagcatttgtctgggaacatctttatttctccttcatgttttaaggatattttttctgaatatactattctagaattaaaaagtcttttttttcttcttcagcacttcaaatatgtcaagtcactctcttctggcctgtaaggttttcactgagaagtctgctgccagacgtatttgagtgcctttatatgtgatttatttcttttctcttgctgcttttagaatcctttctttatcctttacctttgggagcttgattattaaatgccttgaggaagtcttctttgggttgaatctgtttggtgtcctgtaaacctgttgtacttgaatactgataatctttctctaggcttgggaatttctctgttattccttggaataaactttctaccctgatctctccttctccctcctctttaaggctaataactcataggtttgcccttttcagtctactttctagaacttatagtgtgcttcattcttttttattatttttcttttttctcctctgtgtattttcaaatagcctgtcttcaagctcactgaatctttcttctgcttgattaattctgttcttaaaagactgatgcattctttagtatgtcagttgcattttttagctccagaatttctccttgatttttaaaaattatttcaatctctttgctaaatttatctgataggattctgaattccttctctgtgttatcttgaactttgttgatcttcctcaaaacagccattttgaattctctgtctgaaacgtcacatgtctctgttactctgggaatagtcactggtgtcttatttagttcatttagtgaggccatattttactggattttttttttctttatttttttgagatggagtctcgctctgttgcccaggctggagcgcagtggtgcaatcttggctcactgcagcctctgcctcccgggttcaagcaattctcttgccctagcctcctgagtagctgggattacaggcatgagccaccgcacgtggccagagataggtacttattgtagtcttttcagtctgggcttctttgtacccaaccttattgggaaggctttacaagtactcaaagatagttgaatgttatgatctacatctttggtcattgcagctgtatctgtacctgaagataaggctgtagtattagggagtacctgaagcccaataatactgtgactcctgtgtgttcatagacatattaacttggatcttgggtaaaatccagaggaattccctagactaccaggcagagactcttgttcttttcccttagtttcccccaaacaaagagtctctgtactgagctacctggagcttgaggaggggtgacacaagcacccctgtgtccaccaccactggaattgcactaggtaagacccaaagccagcacagcgctgggtgtcttaacttcctggccactgccaatgttcactcaaggcccaagcgctcttcaatcaactggtggcaaatccagcgagacttgtggcatttcccttagcatagtgagatccccctgtccaccagggcctggattcaagaatcttaggaatatagttggtgctctattgtgctgtggctaagctgacagccaagccacaagacaaagtccttccactcttttctttcacttcctcatgcagaaagagtttctccccatggccaccactgccccaggcctgcagcaggtgctgcctgggtactgccagtgttgactcaagacccaaggcctcttccatcagattgtgaatgcttccaggcctaagtccctctctacagaacagttgtctttcttttggcccagaatgggtccagaaacactgtccaggagccaagtcctggaattggtgaccccaggaagccacttgatactctacccgactgtagctgaggtggtatccaagcttaagaacaaagtcccctttactctttcctctcctttcctcaagcagaaggaaaggattctctcctcatggccaccacagctgggaatgtactgggtcacacctaaagtcagcacagccccaggtctcatccaaggcctgcagtgagtatatctggctaatattgatgtttattcaaggacaaaaggctcttttcattagcagttaatgaattctgcctgggtccttctcttcatggaaggtcccagaaggactgggtccttctcttcatggaagcaggtgcccttttgaccaagggtatgtctagaaatactgtctgggagctagggtctgaaatgggagcctcataactctacctcatgccttattctactctggctgagttggtatccaatttacaagacaaagtcctcttcactctctcctctcctctcctctcaagggtaaggaaggagtctcccagagctgtgagctgttctgtctgtggttggggtagaggaaatgcaagtactcccttggctgctctaactggtgtcttgctaggttacatacacaccaagttcactcactctgagtacagcatagcaaaaagatttgtccaggatttgaagcccttgtggtctagcttgcctttcaagtttacttagaaccccagagcactttggcttttggtgtaggtcttgctgaaactcaggtttccactgctgtgttggataattccactctggctaatgctggtctaaatgctctctctatggatgctggctgaatgtttctttctgctgcaacagggcaacactgagttccagtgctaagtcccacaatcattctgctctccctactctgagcacacagattctctcttcatgccacacagctgctgccagtgtatgaaggaggagtggtgtcagcaattcaagattgcctttcccaccttcttcagtgcctctttccttgatatgatgttaaaactaggtactgtgattgcttatctgatttttggttcttatgatggtgatttcttttatggatagttgttcaatgtggtgttcctgcagggaggatgaacgctagagggttctatttggccatcttccttcacctcatcaccctgattatccaactttgttcttttaaaaaattgttttggttcttgtaacatgaatttacactttagaaacaatgagataatatatacagaaaattcttctgggatttggattggaaaggcattaaatttatctatttgtttgaaaaaattacaattttgcacatagacacattttagtcattaacatggtttatctcttcacttatctagatgttctttaatttctctctgcaatattttgtaacttttattgtacatattttgcccagttttgtcagatttattatgaagtatttaatgttattttatacaattgtatgtgatcttttaaatttcagtttccaatcatttatagctagtagatgagaatataatttatatacttaccttgaatcctgcaaccttggtaaaatcactttttctagtagctttttttgtagatttcataggttttgtacatgttgcacagaagacagttttacttcttgttttccagttttgatgcctcttatttctttttcttgcacagtgccctgcctagaagctcctgtacaacattgtgtagaactgataagacccaagattcttgctcttcttccttattttggtgaaaagcatccagtctttcattattaactattaagttagttgtaactttttgatagataaactgtcatgttagagtaaaaatgttagcactgaaattatttaaatacagaactaaagttaaacacagaagcagtactgttacagcacatttttaaattttattgatataatttggaaatttgtccccacccaaatctcatgttgaaatgtaatctcaggggtggccaacatggctgactagaagcagctagtgtgtgtggtgctcatggagaggaatggaaggggtgagtaaacatagcatgttcacctgaaacatacaggtacataccttgagaccaaatgaggaaacagtttggtccatggagagtgaagaaaagcaaggcaggataatggcccatccaggaacgacacagagccaagggaacctcctgcacccagggaagtggtgagtgaatgtgcgatcctgggaatttatgcttcccttatggatcattacaacccttgggtcaggaaatccacttgtgaactcactcagccaggatcttctgtctgtcacatagagctacgtggaatgtcagcagagaagctgctcaggaacacacaaatatccgggagccttagatacctgggctttccaggctttccagcaaaagtagctgcaactctggcaaaacaggaggttatacccccttacctatcccttggagaggcgctgaattcaaggggctgagccaaaatagtctgcaggctccactccatggcacctcacagggtaagactcactggcttagaatttctgtcagccaccagtagtagcgtcgaacctccctgatatggagctcccagggagaggggctagctgctatctttgccgttttgtcaatttagccattccagcctttgggctttggagaatccaagccaactgtgggtggaagcaatcccccagcacagcacagctgctctacaaaaaggggctagaatgcttttatttatgtatttatttatttttttgagacggactctggctctgtcacccagactggagtgcagtggcaccatcttggctcactgcaagctctgcctcacgggttcacgccattctcctgcctcagcctccggagtagctgggacttaaggcacctgccaccacgcctggctaatttttttctatttttagcagagacggggtttcactgtgttagccaggatggtctccatctcctgacctcgtgatccacccacttcggcctcccaaagtgctgggattaaaggcttgagtagaatgcttttttaagtggttcacctatcccattgtttctcatgtgtcaggaccttccagttggaatctccagccacccccagtagctgacagagatttaaaatctccctgaaatggatctcccagaggtagagccaggccgccatctttgctgtttgggcaacttagttatttccagtctttgggctttggaaagtacaagccaactggaggtggaagcagtcacccagcagagcgtagctgctctacaaaaacctggtcagagtgcttttaaaagcaggtccccaatcccgttcctcctcactgggcgggacctccaaactggggtctccagccagtctgtctggtgctgtctggctgatggagatttgaaacctcactaggacagagctcccagagggagggacaggccaccaacttcactatttgggtgacttagccattctgagctttgggttttggagaatttgaggtgacagggactgaagcagacccccagcacagaatagctgctctatgaaaacgtggccacattacttttttaagtgggtcctgttcctcctcactgggtgggacctcccaactggggtctctagccacctcctgcaggtacatttgggccagcaacaggtttatacctccttgacatggagctcctaaagggaggtgcagaccagcttctttgctgtttgacagctttctctgctgatacttccaggtactagaaaatctgaggtgactaggtactgaatacccagcatatcacagcagcccttcggaaaagtggccagactgttacatgggtgcctgttcccatatctcctcaccaggcaggtcctccaggcctgggcctccaggaatcccctgccagagcaattgagtctgtagctctgctactccctggtcagatcccccaggggcaaatgaaagcctctctgccactgtctctacagtggaactgcccttgctacccttggactaacaaaggagcaaagaccctaagtgccttatctacaccttcaaaaagctacagtcaacacaaaaaaagaagtccagtctgtctgccatgtgcccccttccacacacactgtttgtcactagacaggaaaccccctgcttaggcccatagcatggaccctccatcctgggctgagtgtactgagaaactgctgacctgcatctctccgggttggaacccccaggagacaagtaaaagacctttggccatgactactgctaaggtctgttcatctgctgcctccaccttggggaaggaacataaacactgagatctccccagagatgcagtgggcagcccaggagtgccaagccacgatctatagccagcactcaagggggagaggaacccacactttcagagtgttgacagggaatgtggctgcaactgtgagaaaacataggggagccacacaactgagcaagaatctaccaattgaccagtctgcctaagttccacctactggataacaccccaaagcttcaacaccaaaaataccttgctaacataccccacactaaaaccaaagaccagaagtcagcttcaaataaggacactgcacaaagcctcagccctgtgaaaacatctggaaaataagtctcttgactgtattcaatctacactgcagttaaaaagaacacaaactcacaaactctcagagatgagaaagaaccaatgccagagctctggtaattcaagtggtcagagtgttgtatgtcccccaaatgacttcatcagttgtccaacaggagttcttaaccaggctgaggcggtgaaagtgacagaaatagaattcagaatatggataggaacaaagattatagaaattcaggagaacagaaaaacccaattaaaggaaactaagaagcacaataaaataatacagaagctgacggttgaaaaaagaacctaatgaatctgacaaagctgaataacaaatacaagaatttcacaatgcaatcacaagtattaacagcagaataagccaagctgaggaaagaatctcagaaccagaagactggctctctgaaataagacagtcagacaaaaataaagaaaaaagaataataaggaatggacaaaatctctgagaaatatgggaaaatgttaagaggccagatctgtaaatcattggcatccctgaaagacagaaggagaaagcaaacaatttggaaaacatatttctgggcatcatccatgaaaagctccccaatcttgctagagaggccaacagtcaaattcaaaaaatacagagaagtcctgcaagatttgacccaagaagatcattcccaagactcataatcatcacattttccaaggtcaaaatgaaagaaagaatatcaaaggcagctagagagaaagggcaggtcacctacaaagggaaccccatgaggctaacagtggacctctcagctgaaaccctacaagccagaagagattaggggcctatattcaacattcttaaagaaaaaaaaatatcttcaatcaagaatttcacatccagccaaactaaaattcctaagcaaaggagacataagatccttttcagagaagcaaatgttgagggagttcattaccacaagacctgcctttcaagagatcttaaaaggaacactaaatatagaaaagaaagattgctatgagctcgtacaaaaacacatttaaatacccagactggtgacattataaagcaatcacacaaacataataaccagctaacaacacaatggtaggatcaaatccacacatatcagtactaaccttgaatgtaaaggggttgaatgcactaaatgcacttaaaagacacagagtgacaagctggataaaaaatcaagacccaagtggtatgctatcttcaagagacccatctcacatgtaatgacacctataggctcaaaataaaggcataggggaaaatctaccaagtaaatggaaaacagaaaaaagcaggggatgaaatcctaatttcatatgaaagagacttcaaaccaacaaagatcaaaaagacaaagatgaacaagggcattacataatgctaaagtgttcaattgaacaagaagacctaactgtcctaaatattacatgcacccaacataggagcactcagattcataaagcaagttcttagagacctacaaaaagacatagacttccacacaataatagcaggagacttcaacattccattgacagtattagatggatcaccaaggcagaaaattaacaaagacattcagaacctgaactcaacattgtaccaaatggatctaatagacctttacagaactttctacccaaaaacaacaaaatacacattcttttcattgccacatggcacatactctaaaattaaacacataattagacataaaagaatactcagcaagtgcaaaatagccaacatcctaccaaacacactgtcagactatatcacaataaaaatagaggtcaaaactaagaaaagagctcaaaaccatacaattacctggaaattaaacaacatgctcctaaattagttttgggtaattaataacatcaaggcagagatgaataacttctttgaaactaatgagaacaaagatacaacatgccagaatctctggggcacagctaaggcagtgttaagagggaaattcatagcactaaaatgtccatatcaaaaagttagatctcaaattaatacaatagcattacaactgaaagagttagagaaacatgaatacatcaaccccaaaggtagcagaagacaggaaataaccaaaatcagagctgaactgaaggaaattgagacacacaaaaaaattcaaaagatcaatgattccaggagttggttttttgaaaaaaaaataaaataaaatagcccattagctagactaagaagaaaagagagaagatccaaataaacacaatcagatatgacaaaaggaatgttaccactgacctcacagaactaaaaataaccatcagaaacgacaaacacctctatgtacacaaactagaaaatttagaagaaattgataaattcctggacacacacacccttccctagactgaaccaggtagaaattgaatcccttaacagatcaataatgagctccaaaattgaatcagtaacaaatagcctaccaacccaaaaaagctcaggaccttttgaattcacagccaaattctaccagatgtacaatgaagagctgggaccattccaaaggaaactattccaaaaaactgaggagggactcctccctgactcattctaagaggtcagcatcatcctcatatgaaaacctggcagagacacaacaaaagaagaaaacttcaggccaatatccttgatgaacattgattcaaaaatcctcaacaaaatactggcaaaccaaacagcagcccatcaaaaagctaatccaccatgatcaagtaggccacatccctgggatgcgatgtaggttcaacatacacaaaccaataaatgcgattcatcacataaacagaactaaaggcaaaaaccatgattatctcaatagatgcagaaaaggcttttgataaaattcaacacccttcatgttaaaaagctctcaataaactaaatattgaaggaacatacctcaaaatactgagccatctatgacaaacacacaaccaacattatactgaatgggcacaagctggaagcattccccttgacaacccacacaagagaaggatgccctctctcaccactcctattcaacacagcattggaagttctagccagtgcaatcaggcaagagaaagaaataaaaggcatctaagtagggagagaggaagtcaaactgttcctctttgcagatgacatgattctgtatcgagaaaattctgtagtctcatctcaaaagctccttcagctaataaaaaacttcagtaaagtttcaggatacaaaattaatgcacaaaaatcactaatatttctacacactaataacagccaaactgagagccaaatcaggaaggcttcccattcacaactgccacaaaaataatataatacctagaagcacagataaccaaatcagagaagacacacacacaaatggaaaacatcccatgctcatcaataaaaagaatgatattattaaaatggccatattgcctaaagcgatttgtagattcaatgttagtcctatcaaactaccaatgacattcttcacagaactagaaaaaactattttggaacttatttggagccagaaaagagcccagatagccaaggcaatcctaagcaaaaagagaaaagctagctttacttaacttcagggtacactacaaggctacagtaaccaaaacagcatggtactggtacaaaaacaagcacattgactaatggtacagaacagcccagaattaaggccacacacctacaaccatctgatctttaagaaagctgaaaaaaacaagtaatggagaagccatatgcagaagattgaagtttgaccccttccttacatcatatacaaaaatcaactcaagattaaagatttaaatgtaaaaccccaaactataaaaaccctggaagacaacctaggcagtaccattctggacataggagcaggcaaacattacatgacaaagacaccaaaagcaatcacaacaaaagcaacaattgacaagtgggatataattaaacttcagagcatttccatgtgaaattaaactatcaccagagtaaacagacaacctaaagaatggaagaaaatatttgccaactatgcatatccagcatctataaggaacctaaacaaatttgccagataaaattaaataatctcattaaaaagtaggcaaaggacatgagcagagactttccaaaataagacatagatttggccaataagcatatgaatgaaagctcaatatcactgatcattagaacaatgtaaaccaaaaccacaatgagatacaatctcacaccagtcagaatggttattattaaaaagtaaaatgaaaacagatactaacaaagttgcagagaaaaaggaacacttatacactactggtgggagtgaaaattagttcaaccattgtggaaagcagtatggcaattcctcaaagagctaaaagtggaactaccatttgacccatcaatcccattactgggtatataaccagaggcatataaatcagtctgccatgaagacacgtgcatgtgaatgttcattgtggcactattcacaataacaaagacatggaatcaacctaaatgcccatcagtgacacacaggtaaaagaaaatgtggtacatatacaccatgaaatactatgcagccataaaaaaggacaagatcatgtttttgtgtgtgtgtgtgggaacatagatggaactagaggctattagccttagtaacctaatgcagaaacagaaaaccacatatcgcatgttctcagttatgagtaggagataaatcatgagaactcatgaatacaaagaaggtaacatcagacactggggtctacttgagggcggagagtaggaggatggagaggagcagaaaagataactgttagatactgtacttaatacctggatgatgaaataatctatacaacaaacccctgtgacatgaatttgcttatgtaacaaatcttcacatgtacccctgaacctaaaataagtttttaaaataaaaattttttaaaataaagtatatatactttatatatatataaataaaatttatatattttatttatatatatataaagtatatatatatgaaatgttatacccaattttggaagtgaagcctggttaaaggtgtttgcgtcatgggggaggatacctcatggctgtctttgtgatagtgagtgagttctggttttgtaaagtgtggcacctccactccgttgttccagcttccacagtgtgatatgcctgcccccattcaccttctgcttcctgaaccatccctagaaacagtggctggtgccatgcttcctgtgtagcctgtagcactgtgagccaataaaatattcttaaaaaacaaaaattacccagtttcaggtatttctttatagcaatgcgagaatggcctaaaaacagttgtaaatgtaaaatgttgtaaacataatgatatgtgtcaaaagcatgtatctttttggtagaacaatttattttcttttggatatatacccagtaatgggattgctgtgttgaatgatatctctaagctctttgacaaatctccaaagtgttttctacagtgcctgaactagtttacattcccaccaacaatatataagcgtttccttttctctgcagcctcaccagcatgtgttgttttttggctttttagtagtagccattctgactggtgtgagatggtatctcactgtggttttgatttgtatttctcctgtaaagaatagtgatatggagcattttttttcaagtttcttggccacttgtgtgtattttgaaaagtgtcttttgcccatttttaaatggggttatttgcttttttcttgttcaattgtttaactttcttttggattctgaatattagtcctttgttggatgcacagtttgcaaatattttcttgcattctgtagattgtcagttttctctgtcaatagtttcaaatcctgtgcaggagccctttactttaattaggtaccacttgtcaatttttgcttttgttgcaattgcatttgaggacttagtcataaattctttccaaatgctgatgtccagaatggtgttttctagatcttctgctatgattcttacagtttacagtcatacatttagatctttaattcatattgagttaatttttgtaaatcgtgaaaggcagggggtcagttttgttcttctgcctatggctagccagctatcccagcaccatttattggatgggagtttattttgttgaatctctcacagatcaggtggttataggtatgcagctttatttctaggttctcttctctgtaccgttggtctatgtgtctgtttttgtagagtaccatactgttttggttactgtagccttatagtatagtttgaagtcagataatgcaatgcttccaactttgtcccagttgtcaaagggaatgctttcagtttttgcccattcaatctgatgttggctgtgggtttgtcatagatggatcttttttggtttgaggtattttctttgatacctagtgtgttgagagtttttatcatgaagggatgttggcttttatcaaaagctctttctgcgtctattgagatgatcacatagcttttgtttttaattctctttatgtggtgaatcacatttattgactcacatgtgtttaaccaaccaccttgcttcctagaaatgaagtttacttattcatggtgaactaaccttttcatgtgctgttggattcatttagctagaattttttgaggatttttgtatgtatgttaatcagggatgttggtcggtagtttcttcattgtgtttttgccacgttttcatatctgcatgatgctggctttgtagaattagttagggaaaagtagctccttctcaatttttttgaatagcttcagtagaattggtaccagctcttctttgtatgtctggcagaattcagctgtgaatccacctggtccagagctctttttggttggaagatttttttaaaaattactgattcaattttggaacttgatattggtctgctcaaggtttctgttttttcctgatttgatcttgggagattgtgtgcttataggtatttattaattcctctagattttctagtttgtgccaaaagaagtgtgataatagtctctgagaatcttttatatttctgtgggatcagttgtaatgtcatctttgtcatttctgattgagcttacttggaacttctactctttttgttgttgttgttaacttagctagcggtttattggtcttgttcatcctttcaaagaactgacttttggtttcattgattctgtatatagatttttgggtctcaatttcattcagttctgctctgattgtaattatttctttttcttctgctagctttgaggttagtttgttcttgtttttttagttcctcaagatgtgatgttagattgtcaatttgaaatctttcttcttttttttttttctcttgagacagactctcattctaacccccaggctggtgtgtgcatggcacgatttcagctcactgcaacctccgcctcctaggttcaagcggaaatctttctaactttttaaagtagccatttagcaccataattttcctcttaacaatgcttttgctgcataccagggattttggtatgttgtttttctgtttttatttatttcaaataattttttgatttctgctttaatttttctgtttacccaaaagtaattcaggaataagttgtttgatttccgtgttgttgtgtggttttgagagatcttctggtattgatttctattcttattccactgtagtccaaggatatggttcatatgatttcagtttttttgaatttgttgagatttactttatgactgagcatgtgttcgatctttgactatgttgcatatgcagataagaagagtatatattctgtaattgataaatggagcattctgtagatgtctagtaggcccagttggtcaagtgtcaaatttaagtctagtaggcccagttggtcaagtgtcaaatttaagtcaagtgtcaaatttaagtctagccccagtgatctaacactgtcagtagtgtgttgaagttccccactataattatgtggctgtctaaatttttctgtagttctagaagtacttgttttatgaatctgggtgctccaatgttgggtgcatatatatttaggatagttaagtcttcttgttgcatccaaccatttatccacatgtaatgcccttctttgtacttttgtgccattgttgttttaaagtctgttttatctgacattaggatagtgacccctgttcttttctgtttccttttgcatgataactctttctccaaccctttactttgagcctatgggtgtcattatgtgtgacatgggtctcttgaagataacagattaatgggccttatttttaaatccaacttgccactccgcccattttaagtggggcatttagaccatttaaatgaccttgagctttttgatgagcacatgtcacatgtttcataagccgtttctaaatttaaatttgtttaatatagttttcagggttagaatgggcttatgaggttttgtgaagctcaccccccaaaagtgccatttttatcacatcgtaccaagggtctgtagtatctacataatttaagactactatctttaatcacttggctggggtagtgtctgtcaagtttctctattctaaagttattcttcttctcacttcttatggtttactctttagcaagaagtcactatgcacaggcttcatttaaggaattgtgaattatatttaacctccttgagggtgaagtatctccataaattgtttggaattcttcggcaggggagatttgtttatgttatttcattctaattaaattaatgaccaaactaataaactaattctagttagttgaattttttttataatttggattataatataataattttttacttattttgctgctcagataatttcagttttggtcattgaagttctttccagttgccccatatccgtctgacatactcaatagttgtgagttgttgttttttttttttttttttttcagcattcccttattttctggcactataaaatcctctggaatcatcttttatattttctgtcttagccctagcttcagccatttctctaagtagccctgttttcttttgttggagaatggtattagaaaccatgatacggtgctaggtgtgtttgctataactgaaatatccttgattctaggacttctcagctgacagagcaagaaatatttttatatatgctatctcatttactacatttcatttttatttaactaaatttaatacgtttaattttaaaatatgcataactcaacccaagtatcttaacattttaaatctagtagtgtatctatcatttgatctgtatataggtatacaggtaattctgcaatgatatactcttaatagtactgattattaatttcgggtgctgagatgttgattgtaattttatatatacgctgaatttttcgtaatgtgaagatgctaaaaatcaagtcacttatttaaaaagaggaaggaagaaaggaaggaaaggaaggaaaagaaggaaaggaaggaaaggaagaaggaagggagagagggaaaggaaagaaaaaaatagaggaaatgaggaaaggaaaaggaaaaaagtttgagaagataattccatgattaaagtcacagcccttcacacatgtaacctgtaacctgattagatcaatctctcctagctttaactatttcataacataccttgagagagttgataaatctactttttatttattgacttgtgtgtaacaggaaagtgtcaaaacttttaacaacttttttgttcactgctgcttcctagtgtaacatttttcaaagcatattaagtaacaattagggatccaaatttaaaagttgaaatgtaacccctagcatagtgccagtaactaaactgaggtgacagataaacagttatcctctctctctctctgtctctctcacacacacacacactcacagagctacatttgcctacctataagcagtgacagctatgttaaaacttaggccagtaactttttggctttgagaagtatcttgatttcagaaacaagtggagatagaataaagtacagcttagaatcaagccaatgtgatctttcctgtttttgggaaaacatagggctaaactgtgaacccaggtcagccatatagatcagagccttctatctgtgtggtataaaaacccttttatattttaattacttacgaattggtaattcatgtgagccacatttggaaaaatcccccaaatcaaagataatataatcaaagacattaaagcaggaaagtatcttttaaattaagccagttaaagtcctccctaaatatacatacttccatttctcttaataaagtaatgaagactcaaacaataattttctaaattcatagcaaagtcaggactaacatccactttctgtctctctgcccaaggcactttccacttcaccatcctaccacagtgcatcttatctcatgacctataatagataattagagatctggagtaaataactcagcctgtaattgagagaaaacattacgtagttggtcaaggtgagctcattactcataggataatatttgagagacccagtctgcttcatattccctgctctaatcctcctggctcacatttgaaccatatatatatatatatatacacacatacacacacatatatatatatatacacacacacacatatatatacacacatatatatatatgaattacatatatatgaaattggaaatagaataatttacctagtttaattaaaataataacaacactgtatgtaccttcaagaaaaaaatattattttgccctaaaattttccttctgggagtccagaagggactattatcgaatgttctgccttctaacagctatgtttgctttcagtgcattttaagtggaatatttttcacccttctgaggagggcagacaaagactttaattaaacaaacatcatatgggaactcttgccccaaaagccattagtggccctaattagcagatgcagctgtagactctatcaatattagatggtctgtttattgtgtccatttatatcaccctcatcagggagcatgtggaaggcacccaagaattatcaacttcaattaaaactagctcaaatagtgaagaaaatatcccaggcgaaaatgggtcatgtagaagaggaagatttttttttaaagcattctgggaatattaccaagccttctttgggaaaactagaggatgtttgatgatcttattgtcaacaactgcctgagagaagcacagacaattgagagataggctggattacacagatgagtagccaagtaagtcagagcatatccctcctcttcctggggtttccaagtaactaccaggactccaggaggcttcatgctaagtaggcttggaggtggcacatttatttaggcatactcattaaattcatcgttccaggaattatataaagttagatctggaagttcctggaaggttattttatggatctcatatgtaatatgttataaaattatcattatttattcaatttctgctgtgcttttaggtattattcttatattcacaacccaaatctggtattttgcatttttcagataaagtatttaaggctcgaaagttttaagtgctttccaaatgtcgtagaattagtacgtactagaaccagaatctgaacttctatctgattctgaatcccagacagctttctataccatagggcttctctgtattagtcaaaataatttaatattttggcaaatagtttgttaacataaataattgaagacccacaacttgagtttaagccctttcccatttttctaaattctcctagtcccagtttatttatttatagaatcagaatagtgcttctcaaaaattggtttatatgagataaactatgtaaaaagattttggttgtgggatatgcataataattccatttcagatcctattctcacttacattttaccatgaccttattttagacagtttgagtgacgaattcttgatatctctttggaggcttattgggcttggtaacataaagcctcactgaaggataagacatgatgtaattgatctttgtgctctacagaaatataagcttcctttatttattctaattcccaaggaaacaactgctggagatatgtttctgcagtatgaaaattgtgaaatttcaaagagatcatgataagccagaagtaagaaagctgcaatagtttagagtatgcttcccaaaagtttctagaaagtgtccttaaaggcacagcaaaatgaatttgtgtctccatgtggtttgaatgccctacatctaccatgacatttattgaaagatataatttatcggtcgggcgcagtggctcatgcctataatcccagcaccttgggaggctgaggcaggcagatcacctgaggtcaggagttcgagaccagcctggccaacatggtgaaaccctgtctctactaaaaatacaaaaattagccgggcatggtaatcccagttactcgggaggctgaggcaggagaatcgcttgaacccaggaggcagaggttgcaatgagctgagatcacactattgtactccagcctgtgagaccgaggaagactccggctcaaaaaaaaaaatagtgcagttctgtactctgcagtatatatgctttttagatttaaaatcactaaatcatgtgttgacccccttcacaatctttcatgtcatccaatcatgccatgttccaaaaatgtgccgtctttatcctgtggctcctggtgcctcactggaacatccctaagaagtcctagagaggtacaatattctagtgtaagatgtatctgtttagaaagtatttcatccaagctaaaaataagccaaaaatgatttttgcctctagtaattatttctgaggcgattgtcatgaaaatagttgctttttggcactagatctaacattctgatagtaatccttggaggtcaattattcctggatgagaatgacaggcaagaggaaacagtttggggtcactatttatatactagaatattaaaccttaagtacctcagttaacttattgttcaaatggaagcaagatttaatgaaaaataataagacgtcatagtccatagtctttcagttttatagctgattttatctctaggtttactttcaaagcaggtgtcatggtccatttctcagacccctccattcaggcctgagaccctcagtcccctagtttccccagctgtagcaaatgttgactgcctcacagctgaatccctctccaggaattggttatggctgtcagctgaatccctctccaggcatttccttctaagggcaccacctggtccaaggttagcccaggatcttatgccacaatccagaccatccccgaagtgccaccccagttccagagctcccaagcagattggttctgttgttactgtgttacaagtcagtttttccttttattcagtcctacttccttcatcccttttcaggtactgttcctgcaaacaaatatctaccctagagtctatttactgagaaagctagtttacgagagcttcccatactagcaagctagctgcctttaattctccctacccagtggtttctttagacaccatctttaaattgaaatgtgagaataaaatagaaactatgtgaatctgaaacatcattggcatgtgataggtaaggatagtcagcaaagtgattatttccaattccactagttttagtgagagcacttatgcttcaggcactaaactgaatttactcggtcttgctgattttcacaacaaacatatggcataagtattagtatacttgtttaggaaataaactgagatttatttacttgcttaaagtcatagggttagtacattgtgaaattagaatttgaacccacgtcctccttctccaagtctagcagtttctaatctatctgtgaaccattgtgcagtttacagtattttcaactctctgccttctgagcacatggtagaattgtacttcactaccgttgtaatgttaaatatggccatacagcttgctttggttaatgaaatgtgaacaaaaaagctggtgcctttttgctttatttccctcccctgccacagggagtggtgatgttctaaatgatagtggctcaaaactttgtgtccctgaatggagacagcatggtacaggattcccagcacaactcaaggtagtcacggagcatcagggaaaaataatcttagttgtgttaagtgactactgcccatgaattgtttgttatcacaatatagcataaattgatggatacataaatttcaactaaagaacagattaattttttaacccaagatgtactcatggagaattgccatttttttttttgctagaattgtaatgtccttaacatcagaatttgttttataatgtaatgtaattgaaagagtttggattttgcaactacatagacttaatttaatttgaatttctgatctaacataattgattaatgaccttgggttttcatttccctttctcagccctctttagtcatctataaaatgaggctaataatattttcattatagcattgatgtgatagtttcataaaataaagtctgtaaagcttttagcaaattgcctgacactattaatatctattaatagtaacaaataagtgttttatagaatgcagtcttctcacctttgcatctgaaagttattgttaaaaatatagattcccaaggcccattccagacctattgaattagaatctccaggtatgaactacattttgaacaaactccttcggtaattcttcactgagatagaaaaattattgcactaaacaaatgttaaatacttctatatacacatatataaatggtttcgactgccaaaaagccttccacaaagttcttgaaatgatcttagaactaaataggaaagtatcacccagtgcactatagatgcatcaaagtaaactcagcagaggatttgggggactacaaggcatacttcaaagggatagcatcttaaaaaaaaaaaaaaacttggtgaattctttgtctctaagtatcatgagaaacacagtctgatgagggtaatcttagctgatgacgaaggagggtgtgggacttgaaggctggctgaagtgaatcagatgcctatgaaatgaggatgactgccagtgaaaatcagccaaggacactttgatcagcgactcatgcaagtgagcaattataactccggaaattctggaaattttctggtggaattctagcccagaaattttagttccattgttttaggaaaagaggtggttttgattcctgctagagtttttggtagcagtgagtgactttggaactgaatattattatccaaacccccttctctctaggtcacttttcttttttctttttattattattattatagtttaagttctagggtacatgtgcacaacgtgcgggtttgttacataggtatacatgtgccatgttggtgtgctgcacccattaacttgtcatttacattaggtatatctcctaatgctatccttcccccctcccccatcccacaaaaggccacggtgtgtgatgttccccttcctgtgtccaagtgttctcattgttcaattcccacctatgagtgagaacatgcattgtttggttttttgtccttgcaatagtttgctgagaatgatggtttccagcttcatccatgtccctacaaaggatatgaactcatcattttttatggctgcatagtattccatggtgaatatgtgccacattttcttaatccagtctatcattgttggacatttgggttggttccaagtctttgctattgtgaatagtgccgcaataaacatatgtgtgcatgtgtctttatagcagcatgatttataatcctttgggtatacacccagtaatgggatggctgggtcaaatggtatttctagttctagatccctgaggaaacgccacacagtcttccacaatggttgaactagtttacaatcccaccaacagtgtaagtgttcctatttctccacatcctctccagcacgttgtttcctgactttttaatgatgaccattctaactggtgtgagatggtatctcattgtggttttgatttgcatttctctgatggccagtgatgatgagcatttttcatgtgtcttttggctgcataaatgtcttcttttgagaagtgtctgttcatatcctttgccaacttgatgatggggttgtctgtttttttcttgtaagtttgtttgagttcatcgtagattctggatattagccctttgtcagatgagtagattgcaaaaattttctcccattctgtaggttgcctgttcactctgatggtagtttcttttgctgtgcagaagctctttagtttaactagatcccatttgtcaattttggctttggttgccattgcttttggtgttttagacatgaagtccttgcccatgcctatatcctgaatggtattgcctaggttttcttctagggtttttgtggttttaggtctaacatttaagtctttaatccatcttgaattgatttatgtataaggtgtaaggaagggatccaatttcagctttctacatatggctagccagttttcccagcaccattcattaaacagggaatgcttcccccatttcttgtttttgtcaggtttgttaaagatcagatggttgtagatgtgtggtattatttctgagggctctgttctgttccattggtctatatctctgttttggtaccagtacgatgctgttttggttactatagccttgtagtatagtttgaagtcaggtagcgtgatgcctccagctttgttcttttggcttaggattgtcttggcagtgtgggctcttttttggttccatatgaactgtaaagtaggtttttccaattctatgaagaaagtcattggtagcttgatagggatggcattaaatctataaattaccttgggcagtatggccattttcatgatattgattcttcctacccatgagcatggaatgttcttccatttgtttgtgtcctcttttatttcgttgagcagtgttttgtagttctccttgaagaggtccttgtcatcccttgtaagttggattcctgggtattttattccctttgaagcagttatgaaagagagttcactcatgacttggctgtctgtttgtctgttattggcgtataagaatgcttgtgatttttgctcattgattttgtatcctgagactttgctgaagtcgcttatcagcttaaggagattttgagctgagacaatggggttttctaaatatacaatcttgtcatctgcaaacagggacaatttgacttcctcttttcctaattgaataacctctatttctttctcctccctgactgccctggccagaacttccaacactatgttgaataggagtggtgagggagggcatccctgtcttgtggcagttttcaaagggaatgcttccagtttttgcccattcagtatgatattggctatgggtttgtcatagatagctcttattattttgagacacgtcccatcaatacctaatttattgagagtttttagcatgaagggctgttgaattttgtcaaaggccatttcggcatctattgagataatcatgtggtttttgtcattggttctgtttatatgctggattatgtttattgatttgcgtatgttgaaccagccttgcaccccagggatgaagcccacttgatcatggtggataagctttttgatgtgctgctggattcggtttgccagtattttactgaggatttttgcatcaatgttcatcagggatattggtctaaaattctctttttttgttgtgtctctgccaggctttggtatcaggatgatgctgacctcatgaaatgagttagggaggattccctctatttctattgattggcatagtttcagaaggaatggtaccagctcctgcttgtgcctctggtagaattcggctgtgaatccatctggtcctggactttttttggttggtaggctattaattattgcctcaatttcagagcctgttattggactattcagggattcaacttcttcctggtttagtcttgggagcgtgtatgtgtcgaggaatttatccatttcttctagattttctagtttatttgtgtggaggtgtttatagtattccctgatggtagtttgtatttctgtggaatcagtggtgatatcccctttatcattttttattgtgtctatttgattctgctctcttttctcccttattagtcttgctagcaatctatcaattttgttgatctttcaaaaaaccagctcctggattcattgatgtttttgaagggttttttgtgtctccatctccttcagttctgctctgatcttagttatttcttgccttctgcaagcttttgaatgtgtttgctctttcttccctaggtcttttaattgtgatgttagggtgtcaattttagatatttcctgctttctcttgtgggcatttactgctataagtttccctctacacactgctttaaatgtgtcccagagattctggtgtgttgtgtctttgttctcactagtttcaaagaacatctttatttctgccttcatttcattatgtacccagtagtcattcaggagcagtttgttcagtttccatgtagttgagcagttttgagtgagtttcttaatcctgagctctaatttcattgcactctggtctgagagacagttataatttcttttcttttacatttgctgaggaatgctttacttccaactatgttatcaactttggaataagtgcgatgtagtgctgagaagaatgtatattctgttgatatcgggggagagttctgtagatgtctattaggtctgcttggtgcagagctgagttcaattcctggatacccttgttaactttctgtcttgttgatctgtctaatgtggacagtggggtgttaaagtctcccattattattgtgtgggagtctaagtctctttgtaggtctctaaggacttgctttatgaatctgggtgctcctgtattgggtgaatatgtatttaggatagttagctcttcctgttgaattgatccctttaccattatgtaatggccttctttgtctcttttgatctttgttggtttaaagtctgttttatcagagactaggattgcaatccctgtctttttttgttttccattttcttggtagatcttcctccatgcctctattttaagcctatgtgtgtctctgcacgtgagatgggtctcctgaatgcagcacactgatgggtcttgactctttatccaatttgccagtctgtgtcttttaattggagcatttagcccatttacatttaaggttaatattgttatgtgtgaattcgatcctgtcattatgatgttagctggttattttgcttgttagttgttgcaatttcatcctagcatcaatgatctttataatttggcatgtttttgcagtggctggtactggttcttcctttccatgtttagtgcttccttcaggagctcttgtagagcaggcctgatggtgacaaaaatctctcagcatttgcttgtctgtaaaggattttatttctccttcacttatgaagcttagtttggctggatatgaaattctgggttgaaaattcttttctttaagaatgttgaatattgacccccactctcttctggcttgtagagcttctgccaagagatcagctgttagtctgatgggctatcctttgtggataacccgacctttctgtctggctgccctcaacattttttccttcatttcaactttggtgactctgacaattatgtgtcttggagttgctcttctcaatgagtatctttgtggcattgtctgtatttcctgaatttgaatgttggcctgccctgctagattggggaagttctcctggataatattctgcagagtgttttccaacttgcttccattctccctgtcactttcaggtacaccagtcagacatagatttggtcttttcacatagtcccatatttcttggaggctttgttcatttctttttactctcttttctctaaacttctcttcttgcttcatttcattcatttgatcttcaatcactgataccctttcttccagttgattgaattggctactgaagcttgtgcattcatcatgtagttctcgtgccatggttttcagctccatcaggtcatttaaggactgctgtacactggtttttctagttagacggacgtctaatctttcttcaaggtttttagcttctttgcaatgggtttgaacttcctcctttagcttggagaagtttgatcatctgaagccttcttctctcaacctgtcaaagtcattctccatccagctttgttccattgctggcaaggagctgcgttccttaggagagggagaggcactctgatttttagaattttcagcttttctgctctgttttttccctatctttgtggttttatctacctttggtctttgatgatggtgacgtatagatggggttttgttgtgtatgtgctttctgtttgttaattttccttgtaacagtcaggaccctcagctgcaggtctgttggagtttgctggagctccactctagaccctgtttgcctgggtatcagcagcggaggctgcagaatagcgaatattgctgaacagcaaatgttgctgcctgatcattcgtctcagaggggtacccggccgtgtggggtgtcagtctgcctctactggggggtgcctcccagttaggctactcgggggtcagggacccacttgaggaggcagtctgtccgttctcagatctgaaattccacgctgggagaaccactactctcttcaaagctgtcagacagggacatttaagtctgtagaggttcctcctgccttttgctcggctatgccctgcccccagcggtggagtctacagaggtaggcctccttgagctgcagtgggctccacccagttcaagcttcccagctgctttctttacctactcaagcctcagcaatggcgggcaccactgccgcagccttgctgccacctggaagtttgatctcagactgctgtgctagcaatgattgaggctccgtgggtgtgggtccctcctagccagatgccagatattatctcttggtgtgccatttgctaagaccattggaaaagctcggtattagggtgggactgacccaattttccaggtgctgtctgtcatggctttccttggctaggaaagggaattccctgaccccttgaacttcctgggtgaggtgatgccttgccctgcttcggctctcactcggtgggctgcaccaactgtcctgcacccactgtccaacaagccccagtgagatgaacctggtacttcagttggaaatgcagaaatcacccatcttctgcattgctcatgctgggagctgtagactggagctgttcctattcggccatcttggaaccgccccccaggtcacttttcttgattgctctcttcaggagtttgtgtttccatacatctgtgaacagctgaggctgatgaggctgactctagtcccaatgaagcaattaagctttcttgatcaagagcaggagagtaaaaaacactagacttttagtcttgtggattagagaaggggaatccatacccagtgggatcctgaagaaaagggcaggaagaatgcaggtcagagctagttgttgtggcttaagaaaatgtaaagaagcactggggctgacactagctttcagggcctgggtcttcaaagacctgcctttccaggcagaaagctggacaaggagactgtatagcaacttggagcagcagaagttggaggaccatggctccttcaaggaaacacacagctgcaaggaacaggaacattacacacacacacacacacacacacacacacacacacacacacacatcttgcttcttctctgctaaagattttgatgactgatatacaccatttcagagctatataccttctacaaccctcctttcctgttcttgtatcatacaagggaagagagagaggaacccacaccaatagtccttcaaataattaatagtgaattttccacacattttggtgggtagaggagtcttatgtgaatctttaataaaattgagaagtttaaagaaatgtgatattacttgcactttgagtattgagaagtttggacttgtattctaattcatcacacttgcttgagttaaattggggtcagctgacagactcacgttttgatttcttgcagatattgaaacagaatataaatataagtcaatactgtagtattctgacttaacattgacctgaaggaaataacactacagtccttattactccaatcaaataagactgcatagatatgggaataagtctcaaatttgacttcgctttctgtgatgcccttttggagcctaattttgaaaccacagagaaagtcttacagtgctttaccactctgaccagtgtgattctcccctgagcacattctctaggcctccaggcccagaaggccagaaatatcaggagttgatgcattagggagcaaccatcagccaaagagagaccataattagaggttaatatacatcttccttgcccctggggactaggagtctaaccctgtgacatgttctacattatctccctaagttccttgcccattaggattgagcccttgttgtctacagtattaacttgcttgatattgtaaactttgctggcttttttccacttcctgtctcctgtcctcattttcttattggtacttcctgggaccacttcccaaatattctatttgcacacaagtatttgtctcagggactgctctagagaaaatccaatcaaagaacctccttgggttagaaaagagatgtaatgaatacttaataggtgcctagaatggaaatttaaaaatgatgttaaatagccatcaggtgatattgtattatcctatcaaagaaggaagctggctatactccaagggcctctttaatgaggggacatttattgccatggtaaattttccccaatctgaggccttgctgatcttgtcagcagaaagagaacttatcccttgggcatagttatgtatgtcaagctcaatgaactaaggtataatactcaaataccagtttatgggtttaccagaataaataatggccacagggactagaatactcaacctccaagtgaccattacatattgttgctagaggctgatccacatgggattccaaataagtatcaaaggttgtgagaataacatggaatcaggacaagggaagccagaggcactcaaggtctaatggcattagcctcagattccctgatcacctcatctgtgggtaagggtagtagtgcctatgaaaatagaaatagaaaagtcctaggtataaaatctctccaacctttccacattggggattcccttctgaataagacttttagattattggctacatttgaatatcctttggaaaatgcttagatgttgaatgcctttgagattctcaactcctccttctaagtctcatattccttcttaaaatgctaataaattccatcaaatacaaatcagttctactggactgtaaattattcagacttgttcagtgattttgcatatgttagctctaattttaatttccaaggagcaaactcattttcctagtatttaatttggggagggctaaaaaactgcagcccctacatagtaatagcaccaggctggtaatactaaatccaggctgcatttcatttgttatcacaaccagtctttgaggtagaatttattatccgtgttttagtcacaagaaaacagagagcttcagttaggacaagttacttgcttaaggatgaaattggaattcaagcctggatttatctaagtcagtgagtcctgttctttctaaaattaacccttgaacaagttgagatagaagcaccaactccccgcacagttgaaaattcatgtataattttgactcttcaatagcctattgttgactggaagccttactaataacataaacagccaactaacactttttgtgttatatgtattgtatactatattctgacaataaagtgcattagagaaaaaaaatattaggaaaatcataaggaagagaaaaaatatttagttttcttacgtgaaagtggatcatcatataggtcttcatgacgagtgggctgaggagaagaagaaagaggaggagttagtcttgccatctcaggggtagcagaggcagaagaaaatatgcatataagtggaccctaacagtttaaacttgtgttgttcaagggtcaactgtactttgtcatgctacccaaaagttactgtaccaagcttctatttttaaattgatctgaacaaaagctttcactactaggacaaaatttgacaacttctaagggtttatccacctccaagagagtatgattctctaatgctcctggctttgctaaacctcagaattgagatctttttctaaataagtctgacaaaaatgattgctcttggttattcaggggcaagaaactctgcctgagttatctttctaattgcctctgtttttcacttcaccaaccttaggatcatattattactcactggatctccttactaatgcacactgcaccagatattgatatttcacagggaatgaaagtaactttctaaagactgtaaaggatctaattacctgtattgactctgcccagaagcaaccacaaacaatgctgtaattaactgagtttagctataaatgggaaacatgagggtgatttttattatagacgaataaaggcaagctcactaagctgatgggtagcttatttaacattgtgaaatttgttcaatgcttctatactgtctttttaaaaaatccttttcccttctttgctgcttctctttttcccttctccccttccctattaaaaatgtttattttttcccagtataaaattagatggtaatcaaagaacattttagaaaatacagattaaaaatatctattttctactaattagaaatgaccactttaaccttgtaaaatatattttccttttttgttattgttttggcgtagatacataacataaaccactatttaggtttttttcttaaagaatatcagtagatatccttgaggattccagctatttcacagtctccttttcctagaagagatgactttagaacaggctgggaggagagagccaggtaaagaaagatatgcatctatgcaaaggctgcaagggccacaaatacagggcatcggagaagcaagcagtgcaggggctggaataggaagtgctggaaaaggagtggtcaggagatgagcagggccagatgaacatgggccctgaatgccaagaaaagaaatgtggactccagccagaggccacagggaggggatggagtgggtggtagcttgatcagagttccagcacagtgcctggcacatagtaagggctcagtcaatatttatccaatgaataaatgaagaataaatagcagccatgtaggaagccagttaggaaactccagtttcctaagtttgttaaggtctgaagtaaagttctcaaaaatatagataatcaaggtacaatgggttacaagaaagttaaataagattcctgtctcttaccaagtttcccccttgctgggtaggtaagatacttttacttggtgccccttgttactcttcataagcctctgttagttcacttctcagatggaattgaatcttctagtttaattggctatttgatgaattagtgattaaattaacatgcagagagtctttgtggctttaaatgcaaataagcataagatgaatttctatcctccatgcatcccatctaccaatatcctatagatgccaatgatttgccaggtacttgcttgaggtagaagccctatacaatagaaatttgatattctgagcaagcaaaaacttactctttgtgtaatacaaatttaaaaactgattttaaacacttcaagccatagtgttatttcattccttgtagctattttaaatccagttaatgacaaaattgtgagcaagatttaagggcataaacatttgtagaaagaagcttgcaatgaagaattctctaaaccatttaggtagcatacaactttttttctattttcttacttttggtggtggttctgtattattatgtgttttaggcaaaatatttattctcatatatatcagaataaatttaaccagcatatcagacctgtgattttatggaggatattgctaaacaacatctaactttaatcatttaaaaaagtaatagtctggataatacttaatattaacaaagattatggctgtgatacatgaatatttggaagcaatggctgatctcaaatttcaagaataggactgactcttcctggatttcttaagttaattctagttaattttctgggaagagttaaagtttgtcattttatattatttttaacctcagtcaactggaaacagtctttaccatcagaatttgagtttgtgcagtccttagacatctcctctctattcagtactccactctacaaagtacctactatgtatgtacaaggagcttatatatactgtaacattagattatcatatttagtttttatgttgaaccagtaagaaatgcattaatattcctgttttggagatgaggaaattaaggagcaaaaatgttgtataaactttcaaaatcgtgtagctaataaataatgaagctaagatttatatgaaaatctaaatcaaatgtccacgttcttagcacagtatactctgcctcctcaccagcaaatcctatggaattaccaggagttagaaatcagtatgttatagctgacatgaaaaaaaaaaattcacctgagagtaaattcaggaccgtatacataagaagagaaacgacatttagtaatagcccttaaatttgcatcacactttattgtttgcaagcctgtcatgtatcacaccttcataatacctcacatggggtggaaatgtgggcatgggttactattcccattttagatgaagaaacagaattttcttaggaaaattacagcaacttggccaaggttacagcctaatttaaggcagattgagaagcagaatccaggatccgacattgtgaggtctttctatgcatggagcaacttctaacaggcttgtactttagtagaaagcagggctggagacactgttggagtagccaccccagacagatttcacagccaagaagacaagacagaggatttgcacacaaactataccaggcctcatagtcggttttttgttggtggaatttcaaacatctcacctactgcttatgtatatcgtttcatttattgatctgtttcattgttgatccattaatctatccatccatccatccatccattcttcatcgtcgttgtcatcatcatcattgacattattattactactattgaatagctactttatgaaggtactatgctaggatatgaagttataaagtcaaacaagaccagatctctgcttttaaggatctcatagaccaaaggaatagataaatatgaacaaatatttgtattataaaatggcaaatctaaaggaggggcaggaaaagagtacacagacttaaggatggaacaagcaaccactggggagtgagagtgtaatgtagggaaggccccaggatggaggacatacctaaaaggtaagtagtttgaggtaactaagtggaaaggatttttctgaggggaagcttgtactaaggcacagagctacagcatattttggtttgtttagaaaaatgcatgtgttccttaattattggtgagaaaagtgtaagaaaaggagggtaggtagtaagcaggcagggatagtccagagtcagagcaaatctcacagcaggagggactccaggaaccaggagaaccaattctagaggtgcaaagctcagtttgaatgggtattatcaaagagaaagtaggaaatgtggcaatattgtgtgtgtgtgtgtgtgtgtgtgtgtgtgtgtgtgtgtgatgtcagggctctagatactgagaatggatagggaggaggaaaacggtgtcaaagggtgtcatctcagacttatcacaaggtagaaagaaaagttgccggctttttcagaattcttaagtatttttatattaacttctgtcccgtctccttaatactcttctttaagttttaaaataatgtaactacatatggaaaagaagagaaagaaggatatatacacacacatatcacctatcattttgttctacagcattcactgttttagcaacaatattgtgtatttttctcctgttttgtttttatgtctgttgttagaaaattaaaggtaaaagaaaacaattctatataatacgccactatgagaaatttttgccagttatttctttaaaaatgaaaaagaggtagaatacagggcctaatagtgaccctaagtgtgtagtggttcgaatgacaggctttggagccaaaaaagatcaaatacagaattccagctctgacatttacccgttgtacaatttattttttgttgttcttaacttttttttctgaaacattggaataatattacccaactcacagatttggttgcaataaatagtaagttaattcttatatccttttctgtaaaggttgtaagacatttctttcccttttttttataaaagtgatttatgtttttattttgaatttacaaatttagcaatgaaaattctagaagtttaattaatctttatatatggagcacctctatttctagctactctaccttttgtataaatatattaactgacacaaaagctttctatcagaagaccagattttttcagctgtgaggataaagtctcatttagtgttcttttaaaggtaaatctagctgggaggaatgagatagcatagaaaaagctaactgttttaaacaatttttgaacagcgttattttcaacaatataaccatccttatttgttgtatcatttctatttttgagattgctgcatgcaattgtgagattcccttctaggacagtggcatggtagcaggttgtcattgtgtaaaaggggttatgatagaactgaagggacagcaaagctatcaatgatcgtctgtcataatcagtttttttcttacaatcatctcatctcaagaccccataactccgcactctgattgtgcccattaggcacagcagatggtaccattttactccgtggaagcagtgagcagaaaacttgcctccgaccacaacatttgtgagcagaaaaactagacagccttttcccctcagtatgcccaagccctggcatttagttgcagtaggcaagtgatgtaaaaaccctttgatgatctagaagaggaaacatagatacttttattctaatgcacactgttgtgagccttgactatgaagcacacttcctctggctgagagtgtgtgttcacaagctaattaacgttttccaaccctgctttgtcttgccatagaaaagatggatcagatatttctcctgattttatgtaagctgtacatcttttctgtttataaccatggaagaaaaacaataactgtggcaaatgcaaagacctacggcaatacacactctgggtgctgatttggggcatgttactaaatcaatgtgtgacctaggcaattctcttccttagctagttctcagatttctcctctgtgagaatgaaggggtaggatcactgatttgcttcatcctttccagcatcagcatccgatggactaaagtgattaatgttgggcctgtggcaagcgcagattttatggggttccacctagtggctttgctccatattacggttctaagtgagtatggcatggttgtatagaatagaggcttttgaggctacagaccttgctctgagtcctgactttgtgctcaatatccaagtaaacttgggcagcttcttagctctttgtgatttgtttgcttttctataaaaatggaaaataatacctattatataaggtggttatgaagattaaatgttagcacaaaacacaggaataaaagtgagggcagcattattagattctagggaaattaaagtgacagttaaaaatagtgacaactggctggtagatggggacctgctctgggtgcatatccatgaaactcactgtgcatcatataaagatggccagctagacataggtaatatgtgcctcctcctaggagaggaaccaggatagtaagtagatatcagaatagttggcagatactcacattttaaacagatcatatagggcacaatgctaggattccccagagcagtgacaagaagcacccgaaataggtaaagagagagcaagacagcttgcccagccaggaaccagctaaaagttaggagagcctcctggacatggggaaatagtaaaagagaaacccccggggttccaaaatcagcttttactatcatggccaccaaagaaacccttaactcgttagggccttgggcttgacatacagagctggctaaagattgcaaagagatgtttctccagaaagagaacccatgcaaaatttcacaggcacctgagcttggagcagcctcagctgggagctatcttgagagcctagatactggagatctacaaacatggctggggctactgcactgctccaacaagagaaagaagaggctgggcactcccatgcacccctaggagggtgcttgctgccctgctgtgggctgctgtgagactgagatgtaagtggaccatattccccatagcttcttgcccatactgctagactggaaggtactctgcccaccctgggtcccaggcccagggtgagtgccattttgagagtttaaggctgagccatatgtcaccttaggcctgagttcaggctgatgtggttgtagctgccatctggccaaggaggaacaagaagacaaaggtatcctatgtatatctaagacaatatttacttccctgcaacaggctgctgtgagattgagacacaagtggactgtattctccacagcttcatgcccacactgcctgcatgggaggagacccaccctccctgactatagactcaaggtgccattttgagagtttaatgcttggttgtcccctgcccttgagatgagtttgacttgacatggcttcagctaatgcccagttaaagaggtataggaaagccaggcttcccaatgcacatctaggtcaatacccagtaccctactacgggctgctgtaagaccaagactcaagtaaactgcttttcccatagcttcttgcccatgcttcttgcctgaagggaccttacactccctggtcacaggcccagagtgccattctgagaacttaatactgggctgtgccccaaccttgggccaagtttgaggtgacatagttgcagctgccacccagctgggaaagggataagtgagacaaagctctcctaagcacagttaggacaatgcttactgccctgctacaggtggctgtgggactggagactagcccacccaacccatcacagcttccagcaacaacaacatgcgttgcttgggtcccagtgggttgcaccaccattgctactaccatcacccataccacattagctaccaagggtcctaagaacccacccacacactgggaccactgctcttactattaatttctaagcaagccacgtgaaggctcaagaatcagtcctcccagactcacaaacactagagccagtgtaagttgctctggggcctgaaaggaccccactgctactaccaccagagcctgaagactgatttagttggtgtccaggtcactagcttaattccaccacaaactcaactattagctgtacccttagtcactgaggaaatcacagagaccactgccctgtgtactgccaaaatattcatacaaagatcacactaccatgagcacccaaaatcaaagccacagtatcttaactgaatcaacaacatatacacatcctcaggaaaaaattctcccctatgaaagcaatttcaaaaacttggaaaaagtgactgctatacaagatgcaccaaaatcaatggagggacacaggaaacatgaaaaatcagggaaatatgataccatcaaaggaccaaaattatccaataacagatcccaatcaaaaataattcctctttaaaagttcagataaagaattcaaaatactgatcttaaagaatctcaatgagatgcaagataaacctgaaaatcaatacaaagaaatcagaaaatcaatccaggatattaatgagaaatttaccaaggagatgaacatcataaaaacaaatagaatagaaattctggaattaaaaaattcattgaaagaaataaaaaatatatccaaaagtttcaataatagactagaccaagaagaagcatctcagaacttgaagacaagactttcaaaataatcctgtcagacaaaaataagagaaacagaataaaaaatgaatgaacaaagctttcagacatctgggaccagataaagtgaccaaatttactaattattggtattgccaaaagtgaagagggatcaaaaagtttagaaaacatatttaagaaaataatgaaaatttctcatctatcaagaaagttaggcatctagatacaggggacacagcaaccccaaggaaaatacattgcacaaaggacctcaccatggcatattatactcagaatgtctaaagtccaagtgaaataaagagttttaaaattagcaagagaaaaatatcaagtcaactataaaggaaatcccatcaaactaactgtggactcttcagcaaaagtattacaggccagaagagaatgagatggcactttcaaaatactgaaagaaaaacttccagccaatgattttgtatcctgccagaataagctttataaatgaaggataatttaagtcattctcagacaagaaagaactgagaaaacttgccactactagactctagactagacctatagtaaatgctcaaagagtccttaagcaagaaatgaaaggttaatattcaccaccatgaaaacacatggcaatatacaacttacagtttgtataaaacaatcacacaaaagaggaatagaaagatgtcaaagataccacagaatttcattaaaccacaaagacaaaaagaaaaaaaaagaattgtttaaaacaacttgaaatcaatcaataataagccagaaacaaagcctcacatatcaatattaaccttgaatgtaaatgaataaaatgctgcacttaaaagataaagattggcagaatagacaaaaagcccacaatccaactatatggtacaagaaattcaccttgctgaattagactgaaagtaaagggatgaaaactatatggtacaagaaattcaccttactgaattagacggaaagtaaaggggtgaaaaaagatattctacacaaaccaaccaaaagtgagtaggagtagctatgcttatatcagataaagcagactttaaatcaaaaacagtaaagaaagaagatgaaggaggccattatgtaatgataaagggatcaattcagcaagaggatataacgatcctaagtatatatgcatacaacattggagcacctatatttaccaaacaaatattactagaccaaaagaaagagacagacagcaatgcaataacagtagagagttttaatatcccactaacagcactagacagatcattgaggtagaaacttaacaaagaaacattggccttaaattggacttcagaacaaattgacttaatagacatttataaaacattctacctaataaatagagaatatgcattattttcacaatcgcatggaatattctctaagatagaccaaatattaggccaaaaataagtattaacagattgtaaaaaatcaaaatcatatcaagtacttactcagattacactggaataaagtcagaaatcaatgccaacgcagtctggtaaatatacacgtacatggaaattaaacggcatgcctgaatgatcactgtgtcaatgaagaggtatagttggaaatttaaaaattttttgaagtaaatgaaaatggaaacacaacataccaaaacctgtgggatacagcaaaagcagtgctaagaggaaagtttatagcattaaaagcctacatcaaaaaagtagaaagatcacaagttaataacttaaattgcacctcaagaaactaaaaaaagaacaaaccaaacccaaagttagcagaaaaaaggaaataacaaagatcagagcagaatgaaatgaaattcagatttaaagaatacaaagaatcaatgaaatgagcagttgagtctttgaaaagataaaaaagttaataaactactagctaaactaaccaaggaaagaagagccaaataaatacaaccagaaatgaagaagtagacattacaactgataccacaaaaatacaaaagatcatcagatacaatatgaacaactatagtctcacaaacaacaaaacttagaggaaatggataaattcctggaaacacataactgcctgatattgaactaggaagaaatagaactcctgaatagaccagtaatgagtgatgagttgaacatttcccaaccaaaataaagcccaataccagatggattcacagccaaattctaccagacatacaatgaatatcagtcctcctgaaactattccaaaaaatcaaggaaagtgaaattctccctcaccattgtacaagtccagtaccacaatgatacccaaaccagacaaggacacaacaaggaaacaatactacagaccaatatccctagtgaacatagatacaaaaaccctcaataaaatactagcaagtaaaatccaacagcacatcaaacagataatacatcatgatcaggtgagatttgtcccaaggatgcaaggatggttcaaccatccttcaatgaataaacaaaccatccattcaatcaataaatgtgatgcatcacatagaattaaggacaaaatacttaggatcatttcaatggaaatagaaaaaagtttcaatataattcagcatcctttcatgataaaaattctcagcaacttaggcataaatggaacatatctcaacataataaaggctgtttaggacagacccatggccacatcatacttgcagggaaaagttgaaagcattccaaaaagtggaacaagacaaggttgtccactttcaccactgttatacagtacagtactggaagtccttactagagcaataaagaaaaggaaaaagataaaaagcatccggtttggaacaaagttagtcaaattatctattctcattgattatatgatcttacatgtagaaaaccctaaagactcaaccaaaaaactcaaaaatttgagaaataaatttagtaaagtttcaggatataaaattaatgtacagaaattagtagcatttcaatataacaataatgatctagccaggagccaaatcaagaaggtaacctgttcacaatagctacaaaaaaatacctaagaatatatttaaccaaggcagtgaaaggtttgtataaggtgaactacgaaacactgatgaaagtaatcttgcatgacgcaaacaaatggaaaaacattccatgctcatggacgggaagagtgaatagtgttataatgaccatactgcctgaagcaacctacagattcaatgcagttcctatcaaattaccaaggtcatttttcacagaatcagtaagaacaatactaaaattcatatggaattttaaaaaagcctgaataaccaaagcaatcttaagcaaaaagaacaaaacttgaggcaacacactatctgacttcaaattatactacaaggatatcgtaagcaaaaaatcatggtactggtataaaaatagacacagagaccaatggaaccatatagagaatgcagaaataaagccacatgcctacagcaaattgatcttcaacaaactcaacaaaaatatacactggggaaaggataccctattcaataagtgatgctgggaaaattagaagccatgtggagaaaaatgaaactggacccatatctctcaccatatacaagagttaagccaagatggattaaagagctaaatgtataacttgaagatataaaattctagaagaaaacctaggaaaaacgctttttgacatttgcctaggaaaagaatttatgagtaagtcctcaaaagcaaacacaacaaaacaaaaataaacaaatgggatttaattaaacaaaaaccttctccaaagcaaaaagaatcaacagagtaaacagacaaatgggaagaaacttccaaactatgcatctgacaaagggctaatatctagaatttacgaggatctcaaacaaatcaacaagagataaacaaaaaactctattaaaaagtaagcaaaagatgtgaacattttttcaaaagaagacatataagctgccaaaaaacatattgacaaatccttagcatcactaatcatcagagaccacaatgagataccatcttatactagtcagaattgctatcattaaaaagtctaaaaacaaaagatgttggcaacgatgtggagaaaagggaacacttatacactactggtgggaatgcaaattagtgaaacatttatggaaaacagaatggagatttttcaaataacagaaaatataactaccatttgatccggcaatttaacctctgggtatatacccaaagagaaataaatcattatataaaaaagatacctgcaccttgtttatcacagcactatttacagtagcaaagataaggaatcaacttaagtagctatcaacagaggactggataaagaaaatgtggtgtgtatatgtatatgtatatatatgaaatatagtgatatatacatgtgacataaatacatatgatatacacacaccatggaatactactcagccataaaaaagaatgaaatcatgtttttagcaacaacatgggtggaactggaggtcattatccttagtgaaataattcagaaagtcaaataccacatgttctcccttacaagtgggagccaagcactgggtacacatggccatacagagtggataatagacattggagactaccaaaggtgggagagtgggatggggatgaggatttgaaaactatctgttggggtgatgggtacagtaaaagcaaacttcaccactatgcaatgtattcatgtaagattcctgcatttctgtcccttaaaccctgtgacagttacatcttccgtatgaaatgttaaatataccatccctcaaaaaaaatgatctcttctactaatcagatcattgtaactaagcattaatctttacttagaaacatgttgaaattctggtaagattttctaaacattctctatataagtaaccccacacctctacactttggaacactgattttcattcttaggaatctgtgcttcccatgtgggaccatctcaacctttctgcttggaataaactctctttagaaactagaaaataagggtagagccaagatggccaaataggaacagctctagtctacagctcccagtgtgagcaatgcagaagacgaatgatttctgcatttacaactgagctaccaggtgcatctcactggggattgtcagacagtgggtgcaggacagtgggtgcagtgcactgagcctgagctgaagcagggtgaggcatcacctcacccgggaagtaaaaggggtgagggaattccctttcctagccaaggaaaggggtgacagacggcacctggaatatcgggtcactcccaccctaatactgcacttttccgatggtcttagcaaacggagattatatccttagcatcaggagattatatcctgtgcctggctcagaggctctgacacccacggagcctcactcattgctagcacagcagtctgagatcaaactgcaaggcggcagcgaggctgggagaggggtgcctgccattgcccaggcttgagtagataaacaaagcggccagggcactccaactgggtggagcccaccacagctcaaggaggcctgcctgcctctgtagactccacctctgggggcagggcatagccaaacaaaaggcagcagaaacttctgcagacttaaatgaccctgtctgacagctttgaagagagtagtggttctcccagcatgcaccttgagatcagagaacggacagactcctcaagtgtgtccctgacccctgagtagcctaactgggaggcactccccagtaggggcagactgacacctcacacggccgggtactcctctgagacaaaacttccagaggaatgatcaggcagcaacatttgttgttcaccaatatctgctgttctgcagcctctgctgctgatacccaggcaaacagggtctggagtggacctccagcaaactccaacagacctgcagctgagggtcctgactgttagaaggaaaactaacaaacagaaaggacatccacaccaaaaccccatctgtacatcaccatcatcaaagaccaaaggtagataaaaccacaaagatggggaaaaaacaaagcgaaaaaacagagcaaagaaactgaaaattctaaaactcagagtgcctctcctcctccaaaggaatgcagctcctcaccagcaacggaacaaagctggatggagaataactttgacaagttgagagaagaaggcttcagacaatcaaactacttcatgctaaaggaggaagtttgaacccatggcaaagaagttaaaaaccttggaaaaagattaaatgaatggctaactagaataaccaatacagagaagtcctttaactacctgacagagctgaaaaccgaggcacaagaactacatgacaaatgcacaagcctcattagccgattcaatcaactggaagaaagggtatcagtgatggaagatcaaatgaatgaaatgaagcaagaagagaagtttagagaaaaaagaataaaaagaaatgaacaaagcctccaagaaatatgggactgtgaaaagaccaaagctacgtctgattggtgtacctgaaagtgacagggagaatggaaccaagttggaaaacactctgcaggatattatccaggagaacttccccaatctagaaaggcaggccaacattcaaattcaggaaatacagacaatgccacaaagatactcactgagaacagcaactccaagacacataattgtcagattcaccaaagttgaaatgaaggaaaaaatgttaagggcagccagagagaaaggtcaggttacccacaaagggaagcccatcagactaacagctgatctctcagcagaaactctacaagccagaagagagtgggggccaatattcaacattcttaaagaaaagaattttcaacccagaatttcatatccagccaaactaagcttcataagtgaaggagaaataaaatcctttacagacaagcaaatgctgagagattttgtcactaccaggcctgccctaaaagagctcttgaaggaggcactaaacatggaaaggaaaaacttctaccagccactgcaaaaacatgccaaattataaagatcattgatgctaggatgaaattgcaacaattaacaagcaaaataatcagctaacatcataatgacaggatcaaattcacacataacaatattaaccttaaatgtaaatgggctaaatgctccaattaaaagacacagactggcaaattggataaagagtcaagacccatcagtgtgctgtattcaggaaacccatctcatgtgcacagacacacgtaggctcaaaataaagggatgaaggaagatctaccaagcaaatggaaaacaaaaaaaggcagggattgcaatcctagtctctgataaaacagactttaaaccaacaaagatcaaaagagacaaagaaggccattacttaatggtaaagggatcaattcaacaagaggagctaactttcctaaatatatatgcacccaatacaggagcacccagattcataaagcaagtccttagagacctacaaagagagttagactcccacacaataataatgggagactttaacaacccactgtcaacattagacacatcagtgagacagaaagttaacaaggatatccaggaatagaactcagctctgcaccaagcagccttaatagacatctacagaactcttcaccccaaatcaacagaatatatattcttttcagcaccacaccacacctgttccaaaattgaccacatagttggaagtaaagcactcctcagcaaatgttcaagaacagaaattataacaaactgtctctcagaccagagtgcaatcaaactagaactcgggattaagaaactcactcaaaactgctcaactacatggaaactgaacaacctgctcctgaatgactactgggtacataatgaaatgaaggcagaaataaagaagttctttgaaactagtgagaacaaagacacaacataccagaatctctgggacacattcaaagcagtgtgtagagggaaacttatagtactaaatgcccacaagagaaagcaggaaagatctaaaattgacacactaacatcacaattaaaagaaccagagaagcaagagcaaacacattcaaaagttagcagaaggcaagaaataactaagatcacagcagaactgaaggaaatagagacacaaaaaacccttaaaaaatcaatgaatccaggagctggttttttgaaaagatcaacaaaattgacagactgcttgcaagactaataaagaaaaaaagagagaagaatcaaatagccgcaataaaaaatgataaaggggatatcaccaccgatcccacagaaatacaaactaccatcagagaatactacaaacacctctatgcaaataaacaagaaaatctggaagaaatggataaattcctcaacacatacactctccgaagactaaaccaggaagaagttgaatatctgaatagaccaatgacaggctctgaaattgaggcaataattaatagcttaccaaccaaaaaaaagtccaggaccagacggattcacagccaaattctaccagaggtataaggaagagctggtaccattccttctgaaactattccaatcaatagaaaaagaggaaaacctccctaactcatttcatgaggccagcatcatcctgataccaaagcctggcagagacacaacaaaaaaagagaattttagaccaatatcccaatgaacgtcgatgcaaaaatcctcaataaaataccggcaaaccgaatccagcagcacatcaagaagcttatccaccatgatcaagaggacttcattcctgcattgcaaggctggttcaacatatgaaaatcaataaatgtaatccagcatataaacagaaccaatgacaaaaaccacatgattatctcaatagatgcagaaaaggcctttgacaaaattcaacagcccttcatgccaaaaactctcaataaattaggtattgatgggatgtatctcaaaataataagagctatctatgacaaacccacagccaatatcatactgaatgggcaaaaactggaagcattccctttgaaaactgccacaagacagggatgccccctcaccactcctattcaacatagtgttggaagttctggccagggcagtcaggcaggagaaagaaataaagggtattccattaggaaaagaggaagtcaaattgtccctgtttgcagatgacaagattgtatatctagaaaaccccattgtctcagcccaaaatctccttaagctgataagtaacttcagcaaagtttctggatatgaaatcaatgtgcaaaaattacaagcattcttatgcatcaataacagacaaatggagagtcaaatcatgagtgaactcccattcacaactgcttcaaagagaataaaatacctaggtatccaacttacaagggatgtgaaggacctcttcagggagcactacaaaccactgctcaatgaaataaaagaggacacaaacaaatggaagaacattccatgttcatgggtaggaagaatcaatatcatgaaaatggccatactgcccaaggtaatttatagattcaatgccatccccatcaagttaccaatgactttcttcacagaattggaaaaaaactactttaaagttcatatggaaccaccaaagagccagcattgccaagtcaatcctaagtcaaaagaacaaagctggaggcatcatgttacctgacttcaaactatactacaaggctacagtaaccagaacagcatggtactggtaccaaaacagagatatagaccaatggaacagaacggagccctcagaaataatgccacatatctacaactctctgatctttgacaaacctgacaaaaacaagaaatggggaaaggattccctatttaataaatggtgctgggaaaactggctagccttatgtcgaaaactgaaactggatcccttccttacaccttatacaaaaattaattcaagatggattaaagacttaaatgttagaactaaaaccataaaaaccctagaaggaaacctaggcaataccattcaggacataggcatgggcaaggacttcatgtctaaaacaccaaaagcaatggcaacaaaagacaaaattgacaaatgggatctagttaaactaaagagcttctgcacagcaaaagaaactaccatcagagtgaacaggcaacctacagaatgggagaaaatttttgcaatctactcatctgacaaagggctaatatccagaatctacgatgaactcaaacaaatttacaagaaaaaaacaaacaacctcatcaacaagtgggcaaaggatatgaacagacacttctcaaaagaagacatttatgcagccaacagacacatgaaagaatgctcatcatcactggccatcagagaaatgcaaatcaaaaccacaatgagataccatctcacaccatttagaatggcgatcattaaaaagtcaggaaacaataggtgctggagaggatgtggagaaatagaaacacttttacactgttggtgggactgtaaactagtccaaccattgtggaagtcagtgtggcgattcctcaaggatctagaactagaaataccatttgacccagccatcccattactgggtatatacccaaaggattataaatcatgctgctataaagacacgtgcacacgtatatttattgtggcactattcacaatagcaaagacttggaaccaacccaaatgtccaacaatgatagactggtttaagaaaatgtggcacatatacaccatggaatactatgcagccataaaaaatgatgagttcatgtcctttgcagggacatggatgaagctggaaaccatcactctcagcaaactatcgcaaggacaaaaaaccaaacaccacatgttctcactcataggtgggaattgaacaatgagaacacatggacacaggaaggggaacatcacacaccggggcctgtcatgggttgggggcaggggggaaggatagcattaggagatatacctaatgttaaatatcaagttaatgggtgcagcaaaccaacatggcacatgtttatatatgtaacaaacctgcacgttgtgcacatgtaccctaaaacttaaagtataataaaaacagaaaaaaaagaaactagtaaataataaaaatgaaagaaaaaaacaaaacaaaacaaaatgatgtcattaaattataaaagtttggcctggcatagtgagttatatgtgtaatcccaaagctttggaagtcccagataggagggtcagttaaggccaggaattctagaccagcgtgagcatcacagtgacaccctatatctggaaaaaattaaaaataagtaagtagataaattgtaaaattttgatataccagtaaagttacttcaaaattaaatttataaacacatacacaagcagcattatacaaattgaatagtcctatgtctagtgaagaaatatgcctgaaaataaaaacttttccacataggaaattccaggggcagatgagtttagtaataaattattccaaacatttaagataaaaataacaccaacctcacctaagatctgttggagaatggaaaaaaagacatattttaaaatttcctgggtagtacaatcttgacaacaaaatctgacaaggatgttagaagaaaggaatgttacaggttaatagctctcacaaccatagatgcaaaaaatcctaaataatattagctgattactgaatcaagttagataatggtgattttatttcaggttgtttcaacattcagaaatcaatataatccagtatattaaggaaagaaaggagaaattatatgattatctcaacagctgcaggaaaaaagcatttggcaccactcatcatccattcacattaaagtgttagcatagtaaacatagaaataaatatatttaatttattaaagaacatctacaaaactcttattatacactttctgattaatggtaaaatatttgatatttacaccataagatcaggtgaaatacagggtgctcactgtcataactcttctatttaacattgtactgaagattctagccagcaagaaatggcccaagttttggaaaggaagaaataactcattatttgtcctggataacatgattatagatgtgaaaaatccaaaagaatctattgataaactgtaagaattagcaaatgaattcagaaattttagcattcaaataacaatttgcattaaatttagcatatacatatcaatttgcattttgcacaccagcaaaaagcaactggaaaaaaggtaaaactctatctaaggactgatatacaacatttttgaacatagagcactacacaacatttttgagagactgtaaacatattcagaaagaatccagatcaaaagcaaacatattcaggcatactgataattgttagcagtaattgtacagaagccacaacccattaactgctcatcataggataactgtcaggaaatgtctataaaaacttttattgacttcaaagctttgatcatgtttggcagaaaaggttgcggtgtgccttgtgaatgtttaggacatcagagtagctgaagacaataccagtggtcttcaaactacagatgagggaggtcaggaaaatagggaggaataaattaacttatatatataaagctaccatgggaatccaaacagaaggtcaactgacttagtcacctataaccaaggccgtgtattaataatttctgtctgttgattcaatgccaatatgtccccaatgctagatttgtgtatatgaaaagtcatctgtagtcagttttctgactaattgaatttattggggaaactagggctaggtagtgataaacatcagggcaatattattccaagcgtggataaaatttctttgctacttttaggttttgaatttattgaggaccctattaagtgttatgtgctatacaagaggttttagattcatagtatttgttagatattattgtccctcattcaaagataagaggagactgaaagaggatatgcaacttattcaagatacccagatatttaagagtcaagttttgagttcaaactttcattactataaacgtcagatctttttattatatgaggatgccttcaagtttgaagtatgagataagctgtttagctcaatatctgatacatcattactactcagtaaattttattagtattatttaagtataacggaattaggccattcttgcactgctataaagaaatgcctgatgctgggtgatttaccaagaaatgaggtttaattggctcacagttctttaggctttgcagaaagcatagtgcccgcatctgcttctggtgagaactcagggagcttttactcatagtggaaggtgaagctggaacagacatgtcacataatgtggtgagagcaggagccagaggggagggaggtgccacacactttccaacagccagatcttgtgagaattcaagcaatgagagatctacgctccatgatttaaacacccaaacacttcccatgaggcctcacctccaacaatggggagtacagttcttttttatttttttctgttttatttatttattgttttgagacgggggtctcactctgtcacccaggttggtgtgcagtggtgttgactgcaatctctccctcccaggctcaagtctcaagtgctcttcccacctcagcctcttgaatagctggaaccacaggtgtgtgccaccacacccagctaatttgttctgtttttggtagagatggggttttgccatgttgcccaggttggtctcaaactcctgagctcaagcagtacacctaccttagcctcacaaaatattgggattacaggcataagccaccatgcttggcctgggattacatttcaacatgaaatttggaaaggacaaatatccaaatcatgttaataattgtctcatggggagttttttttttctctctctctctctctttctctttctctgtctcatgaagtagagccttagtctcttatccagtaagaattcttcctcttggcagcacatgttataaaaaattataagaataatgtaaggcatggatgaaaattattgctaatctttcctctcaagtaacagttataataataagttgatattccatacagaagctttggctagaatatagcaaattatgcacagtgagctatatttcctctctatagtccctttgtaacaaatcctaaaaaatgtctgtgatgcttttggaagttttgctctaaaactctttcattgacttcaaagctttgatcatgtttggcagaagaggttgtggtatgctttttgaatatctaggacatcagagagctgaagacagtatgttaatagtgaccttcagaatgcagatgagggaggtcagaaaaatggggattgttgaactgctttattcctacagggtattagtcatccaataaaaccttaaattatttaatttatttaacagataatttttgtaacaaatcctgaaaacatcataagtaaactgctactatataaattagttctttcatcttatttagattagattcatgtgtcaatggatttaccataaaggaatctgttccgaccttttgagaatgtgacagattaggttgatcagaaataatttattcctcatacttgcatgaattttggaatttcacctgaataggtatatttgaaacagtaggatgattatggaaaattacaactagttttaaaagatttgcataagctagagtgctcagtatggctaagtcaaaaatgtttcaaatcaaaataaggagaaaagatgcaagttctacaatatttgttaaagcaatacatcaaaattatacattagcctcgtgcaaacaaggaaaattaaatcttaaaatttagttcattataattagtcagtttttcaggcaaacatttttgctttctcacttctcatttctacctgtccagattctacatattttcactgctcagctaagcatcttcagctcctttgaagatgttttttttcacctgctataaatattaaatcttgttttgtggttatttgtatccccacaaaaacatggtttctgtataaatacctttgtcatcactggaatatataggccttaaagacagtgataattttaaaatttatttttgtaatcctcaagcactaacacagtgccttccatctagtaggtgctaaacaaatgttgggttgttgaaaaatcagtaagactactttgagaaaaatggaatagaaattagaaatcgaaaagacaaggtagtcttttttgatatttttatttatgtttatttttcatttatttccaaagcttattggggaacaggtggtgttttgttacatgagttaagtgtttagtggtgatttgtgatcttaagctctctgtgggaaagcatatttttcttgtttcttgtctgaaaaagagacaccaatggatatggaaaaggccatttgagatatatatacaatagtatgtatggaataacaggaatgatatcatgatatttctaatttaccaataattttcagaagaggaaggcaatgtttttatttaaaaatacaattaaaaatagtatccacatgtgaatacacacattgtggattgtctgtgacaaatatatcatctctagctatcttttttccatgacacttcatatttaggtaagccataagtctattagtcagcatatttattgatatggcttagatctgtgtcctcactcacatttcatgttgaattataatccccaatgttggcagcagggcctggtaggatatgattgggtcatgggggtggatctccctcttggtgctgttttcatgatagtgagttcttgtgagatatggttgtttaaaagtttgtggcacctacccaactctcttccttctgctccagccatgtaagacatgcctgcttccccattgccttccaccacgattgtaaatttcctgaggcctccaccaaagcagaagttggtatacttcatgtacagtcttcagaacaatgagccaattaaacctcttttctttataaattacccagtctcaggtggttctttatagaaatgtgagaaaaaactaataaggaaaattggtacagaggagtgagacattactataaagatacctgaaaatgtgaaagctgctttggaactggttaatggtcagaagttggaagagtttgaagggctcagaagacaggaatatgagggaaaatttggaacttcctagagactggttaaatagttgtgactgaaatgcttaaagtgatatggacaataaagtccaagctgttgaggtctcagagggagatcaggagcctattgggacctggagcaaaggtaacttttgttatgcattagcaaagaatctggtggtattgtgcccctgccctaaggatctgtggaattttgaacttgagagtgatgatttagagtatctggaagaaaaaatttctgaacagcaaagctttcaagatgttgcttggctgcttctaacaacctaagttcacatgtgtgagcaaagaagttatgtaaaactggaacttatatttaaaaggaaagtagaccataaaagtttgaaaaatttgcaacctgtccataaatagtaggccatatcatagaaaaggaaagcccattttctggggaggaattcaagccagctgcagaaattcacataagtaaagaggagccagatggtcatagccaaaacaatggggaaaaggacatgaaggcatttcaaagaacttcctggcagcccctcctatcacaggccaagaagcctgggagggaagaatggctttgtgggccacacccagggccctgctgcactgcagagcgtggagacactgtatcccagctgcatctctccatccctgctgctccagttccagctgtggctcaaagaggtccaggtacatctcaggaagctgcttcagagggtgcaagccataagccctgggggtttctgtatggtcttaagcctgcgggtttgcagagtgcaagagttgaggcttggaagcctccacctagatttcaaaggatttatggaaaaacctggatgtccaggcagaagcctgctacaggaatggaaccatcatggagaacttctactagggcagtgcagaggataaatgtggggttggtgaccccacacagagtccccacttaggcactgcctaatggagctctgagaagaggcccatcatcctccagaccctagaatggtagctttactgacagcttgcaccctcagcctggaaaagacacaggcactcaatgtctgcccatgagaacagctgcagaggctgaaccctgcaaagccacagtggtggagctgcccaaggccttggaagctcacccattgcatcagtgaatgtgggatatggagtcaaaagagattattttggagctttaaaacttaatgactgccctgccgggttttggacttgcaaggggcctgtaacccctttcttttgttcaatttctcctttttggaatgggagtatttacccaatgcctgtacccccattgtatctttggagtaattaacttggttgagattttacaggctcattagtgaaaaggactatccttgtctcagatgagaccctggaatttggacttttgagttaatgctggaatgagttaagactttgggggactattgagaagggatgattccatttttcaatgtgaaaagggcatgagatttggaaggggctggggcagaatgatatagtttggatctgtgtccctgcccacattttatttcacattgtaatccccaatattagtgatggggcctggtggaggtgattggatcatgtgggtggatttcccctttggtgctgttttcatgatagtgagtgagttttcctgatatctggtcatttaaaagtatgcaacaccagcccctcaccctcgtcctgcaccgcccatgtaagatgtgtgttataagaacagactaatacatttttccttgtgaaatgcaatctcttttttaatttaaggctaacaaaacaattattatttctatgattattcttttctggacccattttatttcccacaatctaacaggcactagtgctgtgttcccactttgtacctctttctcacaaatctcatctacttttgagaactcaatcagcacaatatataggtggctgcagtttcaacatttatgtttaccctaagctcgccctatatctgtaactgtcatcaacagtgccacttgaatgctccactatcatcacaaaatcagaatctgattaaatagacattaagcaccaagcatgtactaggcactttctagccatacccagtgctgtaatctaattacacaaacaaaacaaaacttaaactttaaacttatgatctctccaccctataaaccatgttttaatgctatcagagctacgatatattgggccatctactgggatctatgtactgtacccaggatctcttaaatatataattacatacatacagatataaatttttaaaatgtaagtatcattatcttcactaaaaaatgatatttagactcagaaaatttcatttgcctaagacttcatatgatagagaaaggattcaaaccaagatccttatgattccaaagtttaagctctttacacgattcctcacttcctctaacctctattcttattcttaaatatagggtagtagtgaagaccatttactggagtcagactacttgagtctgaattttagacatcatacttactatgctagtaacctgaggtcattttactttatttccctctccttgtttttaaaatcaattttaattaattaatcaatattatttttaatataatggggctaatacatatgcatacttcactagattataagaattaaatgaaatatgaagcatgtgaaatagcaactaatacatgataagctctcaatatattattcctgggaatcatgtagtagtcagaatgtctcatcaattctttactaaaattcttctctatccatttccatcttttcaggtttgatgttgatggtccaaatggaggagtccatcatgtcaaatgactggtccattttctatcctagcaaccactttcaaccctggatctgcaacctgttttgtgctatacttcactccatgaatagcctgccagttcttctctgtctaatttgaccttcaggctaagctcaagattgccttaatcaaattcttctctaattaatccaatcagaagttataatttcctcttcctactgagcaaccagaagttgacccttgttttatgattagatagggtttacattcttgggtagtcttaaccatgactgtgacctcaaatatacactactactgtctgcacaaaacagccttataacatagctctgtccccatgttcactaaagcacagatttctgtgatctttgattctcaacaggccttaaggaaagatccttcgatacttggaaatcattctctacttagtgttaccagtcaatgcttcataacaatcagttgtgagtatgatgcatataattgctcatattttcagaattttatgaaaagagaggctgtgtattcatgaggaaaattaactctagcttctgtaggaaacaaactcaaattgcagtggattaaaataataaatttttattttttgctaatgttataatctgcagaggttcaggtgatttgctatggattttgggtgtgctaacttctagatgattcaagcatattgatttacattatgcagatctagaatctcagaatcattcacttctagcaataaggtcagaacaaaattagataaggaataattgaggcagttaatagccaggcctacatagtggtataccaccctccacattttattggccagatatcagtcacatgaccccaaaccaactgcaaaagaagctgagaaatcatttttgctctcttccctggaggaagaaatgggattgatctgcatcttgctagtctctgacagggtaccaatgaaacaaccctctttcccacttccatccattcgtacaattatgcagctgtttcatccctgttccacctaaaaattatatcagatcttatgactatcccattccagggactatcccattcccattccagataataaaacattagttccaagaatagtttcagtgtagtaatcaaaatgtccattttgaaaaataaaactgtgaaaatcatttgaaactaaagttttcctcttctccaactttcacctaagggaagctttcattttcccttgtgcaatctgttgcataacttccagcctttgtgaagccccagaattaaagaactatcccacaatggctcttgaggtctctcaagttcccgatttgttttaaaccagtcttgtttgactgccacaagcttactggtttctatttccccactggaggttctgggccagaaccaacttcagtccttaccttggtctcagactgggcaaatgcccttcgaggaaaaataacataagattatcagctccctttccaaaggcactcctttctctaaaattttaatttagtctttgttgttttcacagtctcttgatgtctttaaaattaggactggtataatttatttaactttttcaaggcttgttttttaaaagtggaaatcctgctttattgatttttaaaagttaaactgattaaatgttaaaattgatttttaaaagttaaactacatttattaaattaaatttcccctagtttcataaatcatttattgagtttgggaatttcttgtattcagagatataatcacgaaaagcattttatctaaagacattattctcattgtgaaattaaagtgataccttagagtaaagagtagaatagtggctactggaggctgggaaaagtaagagggagagatagtcaaagattggttaataaatacaaaatttacagttagataagttgaataagttctagcattctttagcatttgtagcatgactataattaacaacaatgaattatatattttcaaatagctagcagagcagatgttgaatgttcccaacacgcacaaaaaagaaaaatgcttgaggtaatgaatattccatgtaccctgatttgatcattacatattgtacctatgcattaaaatatcacactgtaccccaaaatatgtacaattatgagtcaaaaataataataaaagcaaaaaaatggtttctttaaaattaggtctgttcatctgtaaacatgaattaatatttgcagagttatgaaaaataatatacatgaaagggctttggatagtaaaaaatagtatacaaatgtgaagttttttaaaaaattacaacatggaattacctgaacaatctgaaaagtgggatgacttccccttatactaattacttttgtaagatatatagaaatatggtgtttaaagtatggtcatgaacacctttcccctaaacaaagtcttcttagacatgtattcattcagtccctaaaatagagaaagcaatgtcatttattaaacatacattttttaatcaatcatcttcaggtaaattatctaactgaattttcacagtttcaaagatatcctatacattataaaactaagacaattcgggctgtaatgggttggtaattttacattatagtcacacaagtagaaggttgaagggccagcctttaaacctctgaaagtaagtacaaacctaggctctttgaaccataccaaagattctttttgaaatcatggtcttactggaaagaaaaaggagattataactcgaagtttctctgtagtctcttctgttccacttgcagcataaaatgcattttaaaagttgaatagcatctcctttagtaattacatggccaacgaagctcatttgcctgcaggttgaaggaaatcattctggaagtttccttctggagtattactttctctcaactaccaactacatattgaactcacaattgtactggtatgttagagatccataggggaagaagggtcttagcaaaagtcagtttccagaagatgtagagactgttcagaggcaatattaagaaagtagaggactagacataggttattgaggacaaagtggaagggtttcaaaagttgaggcctaggtgagaaatgggatcagatgagagaatacagccctattagaagttgagagtccaggagacagcaaatgacctggaggtcctgagctttgagaggtgactaataggaacaggaatgaaggcacagtggaattcattctgaaaagcttcaaggcagatgatgctagggtggctatgaatgttgaatggagggaggagtgggtagtagatgaggactgaaactaactaaaaacagaatgagtcccctgtgggaaagcaaccagtgtttgatgatacaacaaatcacagaaggaggggaggacactcccaatgagagagcaagaaactcctgttgactcatctaagaaatctgaattcaataccccaattcttctgccacaaacatttgactatcacttataagtccttaaatttagcataatgttgccattttcagcttcattgttccagctattagatctaaaggaatatcactgtcacctgattaataaaatatagtacttcccaggtatgacattttagtatggctctctttttctttactagaggtctatcaaaacatattcatctcagtttcaatgtagacaatttaaaaccttgctgagtaatttcaaggacatggtaaaagataaaattatctgagagttagcttaactgtattcactactcgcatgctttaagacccatgtctgccttattgcagtgagcctatttaaccaccacaattttattgcaggatataaggcaaactgtgatcaaactaccaatcaaggtaaccagatgaagtgtaaaaacttaatgttaactccatagttcatataagaacactttgtgatataatttttccttctttggttttaggaagaagatgattctagttaaataagtttcatacattaaactaggtacattcaaatacaaatttggtcccagtaaacatattttacttttctaggtagcttattctgttacaaaatttacaacctgtacagttagattttctttttaatctggctcttattttccgaaagcatgtgccatcccttctgcctagaataatctccctacctattctgttagaaaatttttttcagcatttaaaactgaatccaatcatttcctttgtaaaggcttccttgaccctcctatctccactgctacatctctgaagttaatcatttcatcctctgaacaatttatagatatattaaaaaattacatatataaataaatatatatttttgtcgtattattttacaattcatatacatgtctgtctcagtgattattcatgggaatacattatattattttcattagtatatccacagaatagtaactgttctaagtacatgctcaataaattttgttacattgaactatgtttgggcttgtggactaatttgtcacttccttaattttggccaattttgcaatggtgtttaccgaaattaatatatatggttaaatacagtgaagatagtcactaatcagatatgaatacttccttagggccattagagtctagggcagagaaaaaaaagcattgccacctctgaagtgtctccattactggagtttttttattgactgagaaatttttagatggtatatctccatcctccttaccccattcttctttctcctggatcctacatcttctggtacttttcccttcaaaagttgggcatttcaaaaatgtaaaggaacccctcttgccacacacttaattaagaaaaagcttctatgtaagattgtttctcaaacttgagtaaaatatagacctttcttaaaatgaaaaaaaatttatctattactagtgttaactgatatttgttatgttactaagatatgtataagaataagaaagagtaggtataaactcatgtattattttagaactaaacaaaccgaaacacatttctaaattaaatacataaatctaggacttacttaattaaaatcaatatattaattaaatgttatataaatgtcactgtttgacatttaaatgtcaatattgaattcaatagtacaaacatgcattttcttgtcttatgctttactttttgtggacttaattttgttctcttgtactgcctaggctattctgtgtatattttccattattactatcattttaatttcttttttaacagaaacattttttgtaactatgaaaatattattttagtggaccaattaaattaacgatgcataataaaatataataatggaaaaattaaagggccatttaacaaatatttcttcattttatatttactactgtacattttgccagtgagcttgtacaagttggtagaaacaaacaaatggttcgcccaacatatttgcttgcaatctgaactgactgttttggcacaagtccatttgagtttagcatgcctctgttaacatggtgctctgataacttttaaccatcacatagcaccaaactgatcataaacccaaaagcaaaccagagcacagaaatctgttggaaaattaatttttaatttggttctgcagatgactcatttactcctgtgttttgtctcccagatttaatgggactttactgctgcgtcttggaagtgtctaggaaacctcactgggtagtgtctccatcaagacatcttcccactgttggtcattgctatatataatacactgtatgatcaagaagtcactttatttcttgacttgagaaaagcacaggtagcatagtagcattcgccacctaagtactttcctctcgaaacataaagattactggaaccctttcttattatgccagctttttctgtgttggccaaaagaattccctgtctctatttggtcctccaaaacatttttgtttcacatagtcatccaattcttgcctctctttatgttgtattcctaatttgttacacacatgcaattaattataattaaaggtcgggagttataaacactgtgagagttttataacataaagttgtagaagacttcagataagtgagagattcctttcatccagggtatctgaaaggacaacttgaaatacagtaaatgaacaatatccatatccacaatcatatgttgttgttgtagtaattttctggttccactcatccctagctagcactcagtttccttctcttttccaacaaatgtctatctgcttaaccaccaggattggagcctaaacaaagatatatggcagctggcagctccatgcaaattacagaaagtttcccattctttccaggtaactgtagctcagcaccagattgcatagttcggtaagcagggcgcatgctgattttaagccctcattttttcccccatggttgagtgctccatttcaaagcatgacctacacaattgcctatgatggcattgaccatgattcactcagacactgtcacataaaccaatttagattaataaaatacaaaaagaacattaatgggggctttggaaaattaaataaaaattatctttgttctatggaatctatgaaaaaggcactttgtcttactggacatgaataagaaagcagatactgttagttcctgcaggttgatatcatagggccataaagtcttgggattagctttaataggaagctatattagttaggctataacaaacaaaaatgactcaaaaacaatatggtttatttctaatttaaataaattccaagtttttgattgctttttttattttcagggatacaagagccttacatttttaaaaacaactttatggaattataattgatgtgcaacaaactgcatatatttgaaatagacaaattagaaaacttttgaagtatatatttacatgtgaacattctagatcattatagattattctttttttccagccccagatagtcttctcacacacatttgctgatcagtactttgctgaacacttaaggtgtaccctctgcatatctccttagttctctttctgtgcagcactttcctttctattatgctgttttgtgaactccatctgcctgggtccctcccagacttatatctgatgcctcattttagaaaatatgctggaatctgcttgggttcctactccctgagctgcatcttgcaaattctctcaaggcagtaacctggaaaagttgtaggacccacttgtgtgttgttttttaaggattactaactatccttcaatatctgacttatatgtctaatacatagaaaactattgcttcaaatattttgtaaaatttattcattgtttcagaaaggaagatatatctatgccctttctcccactctagttagaagcagaagtgcccagtctccttatatcttgtggctcctccattctcaacatacagcttgcatgatctctatgctcatttctgtcaagccatagaaaaagaaagagccacatgatccacatgaagaatcacatgtgagtactttctgtgagtcaagtctaaaagtggttgctaacttctgccacattttgctggccagatcttaatcacatggctgcacctgactgaaaggtcaacgggaaaaaatactcaaactgtaattacaggaaaaaataggaaatgctttttggtaaatggctagccagtctctaacacattgtgcctttataggcatcaaacatatattttacctctcctcccacaaagtacaagatactcatttcatctcatgggagacaacctgtagtcacatacagttatttatgatcttccagtactatcctcttctcttcatcaagcctgattattatctctaataatcccacagcatttgaagcaaaaattacttattttctcctctatatccactcaataaatagtattggagcagggataggataattaaaaagaaaaagtaaacagtaggatttctactacagtcagtagtgcacaacaatgatgaaaatcctgccaggcaagaattgtgaagtcccactctcctaataaatggagaaaattccttgatttgacttttattttgccttctgaaaagaactttttcactccgttttcttcaggctgacttctctgtctgagtatttcctattaatttctccagcacctttcatggtgatatatttataacagcctattttaagctaataacaacttaatcgttgtatatattaaatatgtatagctttttgtgtatcaattatacttcaataaagtgagcttatttttttaaaaaaatttttttagtatgtttataggcagatgaaactatctggaagcaaataagtttactatattttgaggaaattgaattgctaaagaagccatgaacgaatacaaaaaaaaaaaaatgccttgaccagtcaaggcttaaaaatctggaagactgtaagataagaaaaggggagcaaaagaactacaaaaacagacagaaaacaaggaacagaatggcactggcaagtccttatctatcaataattactttaaatggaaatggattaaactccccaatcaaaagccatagaatggcttaatggataaaaccagatccagtgctctctacaagagattcgccttagatttaaggacacacagactgacagtgaagggatggaaaaagatatttcatgtaaatagtaaccaaaagagggcaggaatggcttttgccctcttagagggcaaaaaatagatttaaagttaaaaacagtcataaaagacagagagggctattatataataaaaaagggtcaattaagaagatataacaattataaatacatatggacctaatatcatagcacttaaatatataaagcaaatatttatttatagatctaaagggaaaaatagacagcaatacaataaaaataggagatttcaccccattttcaataatacatagaacatccagacagaaaaccagtaagaaaacaggaaactcgaagagcactatagaccaaatggtcatgacagatgtatacagaacattccaccaaacatcagcagagtatacattgttctcaagggtacatggagcattctccagaataaagtttatttctagatatagttctaaagcctgattcatttttatttttgatttatcatccgcatatctgccattcacaataatgatagttaactggaaaccatttgaaatagtttgtagcaataatacacactatttggccattgttgctcaaagcctatttataatcttatcttttactgtttcaagtctagaattaatcatctttccccttccctttaggtcctaaattctggaatctatatattgtctttcaattctgactgaaaactgacttttaaataggctaatctctttcttccaatgatttgtcagcaaagcaacaaatagtagcaacacatattcacattgtgtatcttttcaatcacttttcctaatgttacaggctcatagtctaccttctacattactgaagcatttgctttattaaattatttttctattgtataacatagatcactatttttttcagcatattctattattaatccaactataactaaaccagtcctataaagtttaggttgttcttgaggcatcattccacttctggtatcaatattttaatgtaagtcagtaaagtaatgtaatggctcaaacagcataacaatttatttcccttttacataaagtttaaataggtattcatcattggcagtggctttcctgcaactggcttgaacctgggcttgccacgtacagtttctaggattgtggtgcctttcttcatcagtttgcggaaggagatagcatcaagaaacacacataggctagacgtggaagtaaacaaaattttgcccactgtctcctggccagactttagagacatgcacaaatttacctataaggaaggctaggaaatacatacaatccagtggtgtcatcaggagaaagagctaaaaattttagtgtatagctatgcattttatacacagaagccaatactatggaagatagaataggaagacagaaaaaactggatctttcttgacttctttgagctactggatcatgtttcaccatattgctagactgaatatttgctaacattccttttattgttgaaggtgattttagttggaactctgctacttgctatgccaaatcttatgattaatgcaattgccaaataaatttcccattaatatcaactaacaaaccaaacaccacctgctgcctccctgttatctatttgtatgatgcacagtatgaatgtttgatggttcagttgccaatgagtacctgataaaatatcaggtctgcatcctgagagattcagcttggtccaagagatgaggcttcaaaatacatgagacaaatgtttgggaagtctaactccaagtctgaaagagaccttggaatccatgtttatttgagagtaaatcttgtagtaggaatgtggtctgtgataatccactaaggcctcagtatgtactgccacactttgaactttcctagagcagaagaatttccacaaattagtccctggtttaaacttgactcttgttttgtttgttctttccatgttagagatcatctgagcctaaatcacacttcttgatgataacaagtctgaactcagaccttcaactaaattcaaaatgttctaagcactaaccattgaactaaattcaaaccagtcctgggtcaaaatagagcaaaatatagttcccaccttctgatgtcttccttattttatttcctttctaagaacaaaaggaagcacattttaccatttctttcttctgtttttgggaatcattcattcattcattcctttagttaacaaatgtttattagaagtctaccatgtagcaggcaatctgaaatgaactaggaaaaagctagattaagttacttcaataaatcacagggaaaagctcatagaacctttaggcaatgtgtagaattattgtatgatatcatgggaaaagcacaggctttgaagccagatactactgagtttaaacctcagttcaatttcttacaggtgatgttaattatgaaattaagcaatccttttctgatcttcaatttcatttgtaaaatggagctaatacttatatttcaggatcaggctgatagttaaatgctagtaaaaatgcttgacacaaagtaggagtataatgaatattccttcctttcctgtttcctttctttcttccttctgtctcaccttccctctcctttcttgtgccttctcttcttcctttcctcttttctgtttttcttctttcttttccaacatcctaattttcttttttcaggtaaacatgctaattgactaaattcccatcctccaaaattgcattaaaatctcaacagtactccttagcacaaatgccctagattatatgccttttgaatacactattgattgaacaatttaatcactttgaataatataatcaggaatataaataaaaatacattttatgagatacgtactttcttctcttcctaaactactacacggatagtatcttctgattctaaaagtagcacatcaatgcacaattttgaatatgtccattgccactttccagatatatcttacaggtataactcatgaagaatatttagacattcaaactaataagcacaaagggttgaacactaaaaagatggtaggagaaaatattttaaacaagatgcagaagaacatgagaattcagtaaagtcagtaaacttgtttatttatctaattgaccattcttgatttgaaatactactggtttgatttatttcattttagtaagaactatagcagataaactggaaataaatgggtttttcttgactcaatttgcttttattcatcttgaaatgcagtattcattttagtgccttaaaaatttagtctagccagcaaaaccctccccacaaacaccctacccccactgccatcaccaacagcgtgaggatatgcaggaacattgctaccctgctcctgacagtgccctgtatgtgtaccctgctgcattgccatggctattggcacacaagataaagcatagatcatgctgccaccactctgatgaagtgctttggccagcaccatacatcagcgtgttatggccagcaggccaaaatacctcagtttctgtagcgcagcagtttcctaacatcaaggggccagagaacaaaactatcatcccagtactaccacccagagttagagcacatagctcaggaatgccaagccgagacttggctccctaaaatcttccagaaatgaagctagtcaactgaaccaatcttataccgcaattcaatctccaaggtcatctaagaagacaaaagcaaacaacctcatccaagggtcagcaacttcaataactgaaggaacattagcccacacagatgagaaggaaccagttcaagaactttggcaactcaaaaagccatcatgtctttttacctccaaatgactgtactagtccccagcaatgtttcttaaacaggctgaaatgtctgaaatgacagacaaggaattcaaaatatgggtaggaacaaagatcattgagattcagggggaagtcaaaacctaatccaaggaatctaaggaatgtaataaaatgatatagaagctggatcatgaaatggccattttaacaaagaatcaaattgatccagcagatttgaaaaactgacttcaagaatttcataattcaagtataaacagcagaatagaccaagctgaggaaagactctcagatctcaaagaccagtcctccaaattaactcatactgacaaatacaaagaaaaaagaataaaaaataatgatcaaaacctctgagagatatgggattatgtaaaggggacacatctatgactcactgatgtccctggaagagaaagagagagagagcaagcaacagaaaaatcatattagaggatatcgaccataaaaatttccccaatcctcactagagaggccatcattcaaattcaggaaatgcagagaacccctacaaggtactataccagatgaacatccccaagacaaatagtggtcagattctccaaaatcaaaatgcaaaaaaaaattaaaggcagctagtgagaagaggtaggtcacctacaaagggaatcccctcaggctaacaatggacccctcagcaaacaccctacagtctagaagagattggaagcctatactaagaatttttaaggaaaaaaattttcaaacaaaaaacataagcaaagcagaaataagaacctttacagataagcaaatgctaagaaaatttgttgccacctgacctgccttacaagagatccttaagggcctgctaaacatggaaaggaaagaccattactagtcaccacaaaagtatacttaagtacatagatctttgatgctataaagcaactacataatcaagtctgcataataatcaactaacaacacaacaacaggatcaaatctgtacatatcaatactaactttgaatgtaaatgggctaaatgccccaattgtaagacacatagtggaaagctggataaatatgtaaaacccaactgtttgctgtcttcaagagacccatctcacatgcaatgatacccatagcctcaaattaatgggatggaggaaaaatctaccaagcaaatggaaagcagaaaaaagcaggtgttgctcttccatttcagacaaaacagaacacaaaccaacaatcattaaaaaagacaaagaaaggcattacctaatggtataaggttcaattcaacaagaaaacctaatttttctaaatgcatgcacccaatacaggagcacccagattcataaaacaagttgttagatacctatgaagagacataaccacaaaataatagtggtagacttcaacagcccactgacagtattagacagttcattgaggcagaaaacaaagatgttcaggacctgacctcaatatttgactaaatggacctaacaaacctctccacccaaaagcaatagaatatatattcttctcatcagcacatggcacatactgtaatattgaccacacaatcagccataaagcaattctcagcaaatagaaaaaatacctcaaaatcatattaatcacactctcagaccacagtgcaataaaaatagaaatcagtactaagaagatggctcaaaaccatacaattacatagaaattaacctgctcttgaatgacttttgggtaaacaataatattaaggcagaaaccaagaaattctttgaaactaatgaggacaaagatacaacataccaggatctctgggacacagccaaagcagcattaaggggaaagtttatatcacaaccaccaggatcaaaaagttaaaaagatctcacattgacaacctaacatcagaggaactaaaaaaaaagaagcaaaccaaccccaaagctagtggaagacaaaaaataaccaaaatcagagcttaactaaatgacatggagatgtgaaaaaccacacaagatctctgaatccaggagtttattctttaaaagaataaataagattgatagatcatcagttagacaaataaaaaagagagaagattgaaataaacacaattagatatgataaaggaggcattagcactgaccccccagaaatacaaaacaaaacacccagagactgccaggaacacttcaacacacacaaactagaaaacttagaagaaattgataaattcctgaatacatacaaactcctaaattgaaccagaagaaactgaatccctgaatagatcaataacagttccaaaattgaatcagtaataaaaagtctaccaaccagaaaaagccaaggaccagttgaaaccacagacaattcttccagatatataaataagagcttgtatcattctgctgaaactattctaaaaaaaaattgaggatcagggacttctccccacctcattctgaggccagcatcattctgataccaaaacctgactgagacactgcagaaagaaaaccgcaggctgcaggctgcaggcttcaggctgatatccttgatgaacacagatgcaaaaatccacaacaaaatagtagcaaaccaaatccagcagcacatcaaaaaggtaatccatcattatcaagaagggtctacccctggtttgcaaatttgataaacatctgtaaacaaataaatgtgattcattacagaaacagaactaaaaatcaatccacatgattatctcaatagatgcagaaaaggctttcaataaaactcaacatcctttcatgttaaaaaccctcaatatctaggcattgaaggtacatctatgacaaatccacagccaatatcatactgaatggaaaaaagctggaaacattctccttgagaaagaatccactctcactactgctattcaatatgatatgggaagttgaatagccagcttgatcagataagagacagaaataaaaggcttccaagtaggaagagaggaagtcaaaccatctctgtttgcagatgatatgattcctcatatagaaaaccccatagtatctgcccaaaagctcctagatctgataaacaacttcagcaaaatttcaggatacaaaatcaatttcatttctatatgccaacaatgtctaaggtgagaaccaagtcaagaacacaattccattctcaatagccacaaaagaataagatacctaggaatacagctaaccagggaggccaacgatctctgcaagaattacaaaacactgccgaaagaaatcagagatgacacaaacaaatagaagaacattccatgctcatggataggaagaatcaatatggttaaaatgaccatactacccaaagcaatgtacagatttaatgctattcttatcaaactaactattgacattcttcacagaattagaaaaaaactattttaaaatttgtacaaagcctaaaaagagtctgaatagctaaagtcatcctaagcaaaaagaacaaagctggaggcatcacattagctgacttcaaactatactacaaggcttcagtaaccaaaaaagcatgacactggcacaaacacagacacatagatctgacagaatagagagcccagaaataaagccacatacctacatcatctaatcgtctacaaagttgaccaaaatgagcaatgggggaaatgaatctctattcgataaatgatgctggaataactggctagccatatgcagaagattaaaactggacctcttccttacaatatataaaaaaatcaactcaagatggattaaagatataaatataaaacctaagcatgtaaaaaccctgaaagataacctagaaaatagtattctggacataggtcttggcaaagatttcatgctgaagatgccaaaagcaattgtaacaaaaacaaaaattgacaaatgggacctaattaaactaaagagcttctgcacagcaaaagaaattatcaacagagtaaacagacaacctacagaatggaaagaaaaattgtcaaattatgcaacccacaaaggtctaataaccagaatctataaggaacaaaaacaaattaacaagcaaaacacaaacaatctcattaaaacattggtaaaggacatgaacagacacatttcaaaagacaacatacacatggccaacaagcatatgagaagatgttccacatcactaatcattagagaaaggaaaatcaaaaccacagtgagctacaaagtcacacctgtcagaatagctattaatcaaaagtcaaaaaataacagatgcttttgaggctgtggagaaaaggacacacatacactgctggtgggaatgtaaattagtttagccattgtggaaaacagtttggcaatttcttgaagaacttaaaatagaactctcatttgacccagcaatcccattatttggtacatacacaaaggagtataaattgtcctaccataaacacacatgcaggtgtatgctcctaacagcactattgacaaaaacaaagacacagaataaatctaaatgctcactaacagaagagtggataaagaagatgtggtacatatacaccatggaatactatgcagctatagaaaagaataaaatcatgtcttttacagcaacaggaatgtagctagaggccatgatcctcagtgatttaatgcaggaacagaaaaccaaatagcatgtgttctcacttttaagtggggtaataaacattgagtacacagggacacaaataagggaacaatagacactgaggcttacctgagggtggagggttggggggaggatgaagatcagaaaactacctatcaggtactatgcttattatctgggtgacaaaataatctgcacatcaaaccttcatgacacgcaatttacctacattacaaacctacaagtgtactcctaaacctagaattaagttagaaatataaataaataaataaataaataaataaataaataaataaataaataaatgtcaatggaacacacagagaattaaaataaaaattgagtctataattatacattatcatatgtattaagttggtgcaacagtaattgcagttttttgccattactttcaatggcaaaaaccacaactactgttgcaccaacctaatagtatcttataaagaatttggccaggcacagtggcccatgcctgtaatcccagcactttgggaggttgaggctggaggattgcttgagctcaggatttggagggcaacatagtgagactctgtacctacaaaaagttaaaaaattagccgggtttcggcatccctatagttccaagcatgagattttgttcttattttttaacacgttacatatgaaatgcatgagtggctgaggtgggaggattgcttgatcccagatggtcgaggctgcaatgagcagtgattgcaccactgcactccagcctggatgacagaatgagatcctgtctcacagaaaattgtggggatagaaatttttttttttttggtgaagtctcactctgtcttccaggctggagtgcagtggtgcaatcttggctcactgcaagctccgcctcccgggttcatgccattctcctgcctcagcctcccgagtagctgggactgcaggcgcctgccaccacacccagctaattttttgtatttttagtagagacgtgggtttcatcgtgttagccaggatggtctcgatctcctgacctcgtgatccgcccaccttggcctcccaaagtgctgggattacaggcatgagccactgcacccggccccttgtgggggtagaattttttgttgttgctgaatatcacctcaaattaaatctttaatttaaaaaacctaagtttttattaagttgtgtgaattgctttgacacactccagatgaaaagtgctaagtataattagatgtggataatttgcttatgctaaaaattatgttcaaagaccacaatgatttttttctaaaatttgcactttggagaaagtctcaagatacataaaacataatgtatatagcttaagaagattatttttattactttctatttcattttggaaaaaaagtggatgtttttattatcgtttgagaaaggaaatgatattttcttaaaatgctgtttcctgtgatatatcacttcatatgtaatgtgttaaaaataagaacaaactcccattaagattctagtgctgttatatttaaaaagctctatttgggatcaaaaacgataatttgctgagctttatcttaaacatactttaaagggacaatggaccatgactgaatgaactgcatttcataatgtttgaagccaaagaaatcttcgttatataaacaagtaaaactaagaaatatacctacatatgtaatattgtcttaactgtacttacatatctacatatacattacaagagaaataaataacagaataaaatgcaaaaaaattggctatgattgtgctggatgacgaaactatgagatctattttttctactttttatatttgccaaacttcttgaaaatgcatctgcatgaatgtatgctaaaaaagataaaaaatatcccctcttttgtcggagtggtaaatgaaaactcagaattttatgtatgcattggcaaaagcacttatgatttactaataactctaaaaataaatcattttcttttttgcagctatatcttgcttcttcataaagtggacagtaacatacttacagactggtgaagagaagttcagaaaattgttgctgttcagcaataatagttcatatttcttaagcacttactctagtagactatatacaataactcagtactcagaacaaccctataaggtagtaccacttttatgtccattttataggggcagaagctgaggcacagagaggttaagaatcatgctcatggtcacacaactaacaaatggcaaagcaagaatgaatccaggcactttgacttcagggccaacaggcttattatgcctgcacttaccaaatgtctactatgtgctttgcacttttgattatgcaccattgcttaatggaaaggatgatgacctcagatctagatggttctgggtttaaattccaatttaaataagttcaagagatctattgtacaatatggtaactacggtgaataacaatgtattatattcttgataattgctaaaagagtaggtttttaagtgttcttaccatagaaaatgataagcatgtgaagtaatgtgtatattaattagctcaatttagccattccacagtgtagacatatttcaaaacaatgtgttgtacataataatataatatttgtgaattaaaaatagtacatgcatcataaaatacaaatttcaacttaagtatttacatgttatatgtctttagaaaagaaacctagcctctcagcctgtttcttcataaataaatgcaataatggtactatttgataataaaaaagaatagatttgaattacatattaggtacgtacacaaaaaaactctgaggcacattaagtaacttccccaaagatcataccagtagtgagtagtacagccacagttcaaactcaggtctgcttgatgcaagacagcatgtgctacagagtttcagagaggctggggaatcacttctagttgacaatgttcactgatactttcacagagaagattgaattattttaatctttatttttatagcatgggtaatagagttcttttagtcttacagtgtaaatcttatgtttagtcttagaatattagtgtctactcttactgaagagtttttaaaatcttatagcatgggaaaagaggcatagtgacaaattgtgacttaacttttctatagtgatgtcttcaatgtcctaacaattgctcagttacttatctgatgtaattttcaccactacggagggtggataatattcatcaaattttactgctaaagagcctgcagctcagagagaatcaatgactgctcaagatcacgcttcaaataagttgtagaacttgtactagacccaataatttgtatttttcagtaagatttgaaaagccatgaatgcaaagttaagagttcgcctcccagcatacagtgtcccagggatctgctacaagtgtttcctactttctgcatatatgaccatcattttccttgctgagacccataattatagccttttctgatgtaattttcaccactacggagggtggataatattcatcaaattttactgctaaagagcctgcagctcagagagaatcaatgactgctcaagatcacgcttcaaataagttgtagaacttgtactagacccaataatttgtatttttcagtaagatttgaaaagccatgaatgcaaagttaagagttcgcctcccagcatacagtgtcccagggatctgctacaagtgtttcctactttctgcatatatgaccatcattttccttgctgagacccataattatagccttttcagtcatgcttgtcagcccagtgttccaaatcttctttttttctagttctgctaacttttctgtataataaatgccaggcagcactagctaattaacaaacagcagacaatgcatgttgatacataactcttactcttccaagccgatatttacttccagtgacttgtgacctcactgtgaacccaagtggcaataaagctaccaccgtgattaggggtagaataaatgtaatctgcttagccttagttgaaactgtgaaaatctctttcatcttcaattattatttatttggcccatttctccggggggcaaggggctgtctaatctctcaggctgagcctcaggagtctgtagcaacagcaaagaatgccagatctgcataccaagaactgggagtctgggccataaatctaagaggccacggccccaatgggggtggagataaggaagtttcaggagcatgcttgtttgacagttattctccaaaggaactgctttcaaaatggatcaagaaaagttcctagcattgtacaatttttctaagtggaagagaataaataaactgtactacctttagaaacaatacataatgtatagtaaactgagacactgcagagtgactgaggagtgaccccgctaattgaactattgcattcccaagggttctaatgtcagcaaggcaaatatgtgccttggagactcacaggcattattccagaactgccaagaatattgaaaatgtgtttaagaagaccatatgcccagattagattaccttggaggaactcaactttaatcagtaaatagtaaagttttggccaaagtatccttgccttaaatggagaaagcatttgggcatggagactcatgcttataatcccagctatttgggaagccaaggcagaaagatcagttgaggccaggagttcaagaccagcctgggcaatacagaaagaccctgtctctacaaaaaagaaaaaaaaaattgctgggcaagttggcacacagctatagtcccacatattcaggaggctgaggtgggaggaccacttgtatccaggagttcagggctacagtgagctatgattataccactgcatttcagcctggctgacagattgaaacactttcaaaaaaataaaaggtgaaatcagcagcaaacacttgttccatgggtcttggagtttgcgacgcctacaaccctgatattcctgagactaatagtaccaagcaagttggaagaattggtgcctctttttggatttatcatgggattatcaacctcaagcagcccaatagccatgtctaggggtcctcaggtttttcttatgtctctgttccctctaacatagaccaatttgtgcaacaatataccttgcttgggaaagatgattgattccagcagtctttataagtatctcttttccaaggtgaactggtggaatgaggaggcaccaatcatctgtatggttttgcaaagatctgggaaacaaactctgatcaatataaaaatatcgccaaacacctttaactggtagacgtgagtctaatagatcagaactaagagtttatttttctttcacaagaaaaaaaaatcaaacaacagcaacaactaaatctctcatcttttctctttgcctgcattttctatctttgttttgagttcttcttaaagttctaaatatagggtagtcattaggtgacttgggggaaaatggtagaaacagccagttttcccttcctccaaggttgcccctagttgagctcagctcactgaaaggatcttccaaaattaatacaatttaagaattcctgcttcccataggtcatctattatttatttcactaaacacctaggttattgttgaggttaagatatgtcagagcttgcaaatctacaggcaacataaaatttcagtgctatttaaatacttcttatatggtgggtgaaggtggggggcctgtattagtgtttttacactgctgatacagacaaatctgacaatgggcaatttataaaagaaagaggtttattgaactcacagttccacatggctggggaggcctcacaatcatgatggaaagtgaaaggcacgtcacccatggtggcagacaagagaaggcctctgggcctgtgatagagggatagagggggctgccatgaagacctctgaaatgccctggagacattttccccactgtcttggggattaatactcatctcctcattacttatgcaaatttatgcagccggcttctattgataaccagtttctattgataaatatttaggttgctactaaaaataatgctgcattaaatattttgtgcatttctcctcagaaaatgggtttttcttttctatcgcattgttaggctgcaaattttccaaacttttatgctctgcttctcttataaaacctaatgcctttaacagcatctaagtcacctcttcaatgctttgctgcttagaaatttcttttgccagataccctaaatcatctctctcaagttcaaagttccaaaaatctctagggaaggggcaagatgctgccagtctctttgctaaaacataacaagagtcacctttgctcgagttcctaacaagttcctcatctccatctgagaccacctgagcttgaaccttattgtccatattgatatcaggcttttggtaaaagccattcaaccatctctaggaagctctaaagtttcccaaattttcctgtcttcttctgagccctccaaactgttccaacctttgccccttgctcagttccaaagtcacttccacattttcaggtatcttttcagcagcaccccactctactcataccaatttagtgtgttagtctgttttcacactgctgataaagacatacctgagactgggccatttacaaaagaaagaggtttattggactcacagttgcatatggctggggaggcctcacaatcatgttggaaggtgaaaggcacatctcacatggcagcagacaagacaagagagcttgtataaggaaactctccttttaataccatcagatcttgtgagactaattcactatcacaagaatagtacaagaaagatctacccccattattcaattacctctgactagctccctacaacaacatgtgggaatttaagatgagatttgtgtggggacacagctaaatcacatcagggccctgggggtatacattttccaatagtttttctaggaagctgctgtgacattattatcaaaaattgataaagaaagtttaattgattaagctgtatatttatgttttgggaacctagcactttttaaaaagtagataaatagatctaagtatctcttcaaaatcaagttgctaattaaaagttttcaatgaaagactttgtaaaccaagttgagcaagtcttccagaaagtagaatacagagacaaaaagaatgaaacattgtttaaaaagtcttaatggtgtcctcgcgttagactttaaaattttgagagattggccgggcgcggtggctcacgcctgtaatcccagcactttgggaggccgaggcgggcggatcacgaggtcaggagatcgagaccacggtgaaaccccgtctctactaaaaaaatacaaaaaattagccgggcgcagtggcgggcgcctgtagtcccagctactcgggaggctgaggcaggagaatggcgtgaacccggaaggcggacgttgcagtgagcggagatcgcgccacagcactcccgcctgggcgacagaacgagactccgtctcaaaaaaaaaaaaaaaaaaaaaaaaaaaaaaaaaaattttgagagattgagaacaaataaaaagagagagaaaattatcaaagaaataatgcaagaatgcttctgataaatgaaaagcatctgtgtccagatgaaagagaccgcttggtgacttaaaccaagatgtgttaactgtaaaatttcaaaatttcaagaataaataaaaaataaatagtaaatccttaaagattttcaagataattacatattaatttcattgattttaaaaccaatccatatatatcctagataatttagaaaagtataaagaagaaaaatgtttgttctagttatatgtataatcatgtacatatatttataaaatctggataattgatatatgtatgacatatatatgtaattttatatttagcttttttccaaataatacaatagcatgaatattcattccattaatattcttcataaacatgatgtttaatggctataaaatattaaattttatggatatgacattgtctatttagccagtttctattgaaaaatatttaggttgctactaaaaataatgctgcattaaatatcttgtgcataaatcttggaaagactgcctgattatttatttgggacagatttttagaagaggaacaactgtttaaagggtacttactagttgttggataattatgcctatctttaagacccttcatgcatatgacctggttgtttttgagaaggtgctatcaatttagagaagatactcaaaggaggttaaaagggtgtatgaagtaaagggatcaggctgactctgaaattagtggcagagtcagtaagggaatgcagcccaataacttccacactagcagtctttgtgcactcatcttcccattgctttttatggatgccagtagcaaagttcaagcctcttataaaaaaataaaataaaataaataaaacaaaatgccaggtagcttactgcatttcaggctcaaaattgttgccaataacataagacatggtcttgcatgattcatatttttcattgtcattaaaagacttactgagtgcctgtagtagtcaagacattaaatacagcctggcataaacaagtatggaccatttcttgagcatgccagtatcatggagcaggctgcaccttgtgctggtagggtatatgcttctgatttcatgggcagagtcaaagaggagggcaacaaaatctacaaaaagaatgttggggagaggtagaatggtgaaatggcatacatataaactgctattatatatgcatgctaagcagagacatgacttctttcagactcaaggagatttatcatttaaggtttggtttggctgcataaacagaaaacccaactcatccaaaggttaaaccaaacaatgtattcctctcacacataagttcagaggttgggataagaggagtgagtgtcctattgcagtagtaactttattttattttactttttagaggcagggtcttgctatgttgcccagtctggacttgaactcctgggctaaagtgaacctcccacttcagcctcccagtagttgggactacaggcagatgccaacatgcccagcttgtagtaatttatttttgaagattgatctgagagtggtaagataggaaaaagcaggggaaactgaatcaggaagatgtccttagggaacaactacttgatgagatattaagagggactgaaatgacagcatgaatgaaagagacaccggagagaagaatttgcaagttggtgttgaaatggaaaagtagggcacaagcagaaaagaagtgaagatgatatcaaggtttggatattggtgaccctggtgggaatttcaatccaaattgggaagagacagtcaattccctttcaggcacatggagcttgtcttcatgaactaagccagggctactatggcagagacactccaggacagcgtgagtaccttgtctaactggttttggagtatcagcctgatcatgccacccatgaaatagtgcgttggttcccttaggagggcacacctctcagcgctgataagattagtgtgatcagaatgagaaaggttggctagaaaaatactgaaacctaaaacacccagcacttggtggccagacaggaaacttcattgtctctacacactgaatgctgaaacctggaacaggagccactggaaatcctcatccaagacctattcagtacacatttgactttaactttgttttcttcttttgatatcaataacatttccataaaaatgaaatgaatatagaaaagcaggaaaatatataaaaaagaagcaataatctcactatccagagataaactctaatatgtgggtacataattttctgtaccttttttccatcgacaatgtgtgcatgtttgtgtaaaatggaaattatgtattttatgctaaattggggactctaactttttgtgatttgttgacctcccatttaaaaatgttatgaaaaaaattgtgaacatttttccagctgcaatattttcttcaacattgtttataaaggctgtataatgtgccagcacatacgtataccattacaatatttaacctcatgtgtatttagggagttgtgaatttttgtttttataagcaacactgcaatcggaattcttaaagctaaatcgtcacatacatctttagtgatttccttaccataaattcctaaaaatggaattaacaaagggcacatgcattttaaggtttttgatacatataaccacatttccctttaacaactttttcttatgttagtcccaccacaggatcatatgatagtatccattttttacattctcatcaaaattggatatttttagtactaaaatatatttgtcaatttaaaaagtaaaaaatggtattacattattgcttaattttcatacttttattactatcctagtgaaaaatacacttttcacattattggctttttgtttgtcttgtgtggtcaattgcttatttatatctttatctaatttagtgtttaaaaaattattagaacaatttaatataaggtatatttccttttgcctgtcttaaatgttgtaaaatttttctcattctgaaagtatcatttttcttgcttctggtaattgttaatgtctacacgtttagttttttttttttccttttattatttctgcctttcacataatattcaaaggtcctttctccacaataataatgcataaatattcacctttttgttataatagtaattttgtgaagtagtggaaatgctgtcaggaatttgtctgagatgggtaacaaagagagaggaatcaagagtgactgagtttttgagcttggtagactttggtgagggtggaaccactgaccaaaaaccaggaatacaggaaagggaacaagtctgttagggtagataatgagttcagttttgcacatgttgcatttaaactgtctgccagaaagcctggtagaaatgcccaacgggcagttggaacaagtttatggaatgcaggagtaaggttgtgttttaaatacagatatagaaatcatcagcagacatttgatagtttaacaacatgttcttttcagtgcatatcctgggccaagcactatgctaagcacttcacagaattttatttggtcttctcaaaaaaaaaataggaggttaaaattattatcctcattttatacatgaagggacaagcttgcaaaagttaaactactttacaaagttcttatgactgggtagtggtagaacttgaatgtgaaatcaggtaagctcacctgattccagagttcctaaccccatttgctctattgtcacaggagtagatgagctcaagcagggaaagtcagagtcccaaggatgaagaatagcaaactttagtggatgggcagaaaagaagggaagttgtgaaggagtctaagaaggtcagagtggaaggcagaaggtcatgtgtatacatgctgatgctttaaccagaatggaagcatttttgatggcagggacttatatcttatacactctttgagataaacgtgagacctttcttctgaccctgatcctcaaaaaactctgttacaatgctttgtacataaatatttcttcgtttatgctgtgatggtctgtcagtaattttcttgcgttaaccttctgagctagaccctaccagtctctctgtcatcacccattatggaataggggttcattcactgtacagcctcagtactatcctatcgccttctctgagagcaacagaagtagattccttgtatatgctctctatgtgcactgggtcagacctctccccacaaatgcacagcatgccacttttacttgtgttgactttctgcccgagttggtgagagattatgggatatatccttttatctttgaatcatagatttttcttttcttcctttattggctgtttccctgcatagttaagactttatcaaatggaaatagaatcaatctcttttctttatagcctgaatatttagtagcatagcagaaacaaagctacagtagaagcctggacctggaatttatcacatgctaaaggagtgtggtatagtagaaaaagcacagatttaggaattactggttacgattctcatgctgtcactccatatctgtgactttggaaaaattatttaaattctttgagccctatttccctcattataaagtgaagatacttgctacagagtggtcgtgaagatcaaataaacttaccaagataaagggcttagctcattgtaggttcccaggataaggaagttgaaattctagtacatacagaatcatttttctccatgttctcagatgcttgcctttcggccattccatagcttatttccactcatccatgttagatgtgttagtagaaaaatacaccccgattcagccatgcctgtctggcacagctaaggcacataattttagttggtgataaatacactgctgaaaatggtttaggtcatactctggttttcttgattcatactactggtgggttaaaaaatgcacttacaatcagtttctcatgataacccgtaaatatcctattgtagtctttttttttctggaaaaaaatctagccagaaatttctcatagactgaagagtatttatttcaagaacatcccatacagaatccatcttggcctctctccaaataacccaaaagttgcttcctacttctagacatctgctgcaatcctgaatcaatactagatgactcaaattgcaagttagcacaggtttcagacaagcctagtgggtaaagagagaactttttgaagacaagaaagaaataagctgcaactttaacttggcagacctatttattaaaattgtggtttaggagaattttccaaagcccctatagctgtagatctcatttgagagcctcaacttctccctcttctttaggaatgaatattctttaggaaagtcctggcttgttcctgttgtttggtgtaattattcatagtgccccctttcactctcaagagtcatagtttgaatgataaaatatatggtcatttcttccaggccttttgcagagtaaaattcatctgttgtaagatatatttcttgtattaatctaagaaaaattagattaccttttctataacagagcccttgggaccccatcttgcagtcatttacatatttcttcagagcaataattaaaagctcacataagctaatgaataactccccatggctctcttaatggcaaaagcaaataatgtgacttcacaggggctcaccaaacacagcagctctaggaggaaaacatgagggtttgtcccttcaagtttacatttgcaaagcaatttgcaatcattgtagtttttccatttcataagactaagtacccacattggacagaaagggaatggagactaagagaaacctaatgctgtgccttctgggatatcattcttggcttgaattctgagcactttgtggtctcacacaccttttacaaacttgagtcatcagccttcccgaccttggtgagaagatgtgctgtggtttagcaatttgagggtagtaagcttgtcaaaacatcaccagagatgttttgagaattactgtggagaacaggtttccatggtgcagtgtggctgctgggagggggacgaatggcacagctgttctctccatggggaggaagcactggatcttttgtgtcagaaaaagctgagatcctcctgataatcctaagccatcttgacaggtatatgttcaggttggggaagataggttctgaagaagcatcataattgcaggggacagggttgaatgaaagaggaggcaagaatggtctagctgcttgataatatcctttccatctattcactgtctggcttgatccagtttatagtttgtccctggctacctggctccctgtctgcagcctagttctgagtgtagaaaataagttcaaagcaaggaaggggagtacatgaaggtttgtcctccaaaaagaatgttcttggattgcctttgtcttgtgggaaaatgtacagcagcagaggaaagaatagcaccatgaaaccagaggagaactatggcatcatgtttgctttgagatggcctttcttccaaacctaaaagaggagagaaaacatcacctctttggcagtggtgctcttgtggggtgactagaatcagctagggtgtcactcctactagacaatgtctagaagacccagaattctgatattttagagtccaaaggactttccagagatcttgcaacctaactccctcattttacccaagggactttcaggttcagagacctaggcgccttttacgaagattttactgaactgctaggctggggtgcttaccaagctactgtaatctaaaagtcttaaaaatataaaccgagagtaatttcttcccactgtgaagaatgatcatgagacctaaatgagtacggctggaaacaaaactgcacatacttcctgcctggccaaggaacttgctcaccatggttggctgctgtccctgagagaggaatctcctacccccagagaggcaataaaactgaagcttcaggaccccttccaaggccctagacctaattatatatttttgattttgcattcttttgctcaaaaagctacttcctccaattttatcagcttcaggaccagaaatcctgaactttgccctgcctgtcctacctcataaatccaaatgtctgatgttccaatatgctcttgctcaaaagagaacagataagggtgaggatgactctgccgggaccaggcttgggaaaacagtacggggctggtaagaaagttgggttgggtataattttgaaggctggcccacaagatgtctcaaactcctaccttgtttctaccccaggagcttgttggccagacaaagcctgtctctcagatttacagacccaggattttagagctggcaaaggtctcattttgtcatcctccctaattttgcaggcatttagaatggcttaagcatcttgggctactgaattcccctccctgggaagtgaggtgacattgttggctaattctttaagcaggtagagtatttgtctcacttgttagatgtgatcttcttggtgtgtcctcgcatgggtggaaaccagtaaatgaggcctacccagctaagcacttcaataaaacacaaacgactgcaattctacacactgtcacttagtgtccattctgagcaaaacttctgagttactctctgaggaaagatgaaactgcacaggacagtgcctgtggacagtattttaagcttgtccctcatttcatagtaatagctacaatttatttaccacctactatggacccagcattttatcaacaatttcatttgtatttatttatttatttatttatttatttatttagagatagagtcttgctcaggttacccaggctggagagcaatggtgtgatcttggctcactgcaacctctgcatccctggttcaagatattctcctgtctcagcctctcaagtagctgggattatagtcacctgccaccacgcccggctaatttttgtatttttagtagagacgggtttcaccatgttggccaggctggtcttgaactcctgacctcaagtgattcacccacctcagcctcccaaagtgcttggattacaatcatgagcaaccatgccctgccataggtattatcattctcctttcgttgatgtggaaaccaaggctcagaggttatgtgacttgtcccgggtacacatcttcagcatccctctgcttgtttggggcatgtggaggctaaagtttagggagtgtcaggccagaagaggaaggcagaaagacaatggccttgccaaacctcctttctccctttcacacaggcctgtgtttaagtcctagttctaacacatactagttatgtgtgcccttgagaaagctgctgttaatcttggtttccttatttataaattgaagaaaataacccacttcataaagcaattgagaagatgaaatgatagaatgtgagcagagctccttcacagcacattcaggtacaaaatagctcattttggtataaactgctcaccccctagccctgaatgcccaatttctcattttctttatgtctttactaaattgtctccatcttactgaaaccttccctggccaccctatctaaaaggcaaaccccatataatctcttcacatcccctttctgccttattttattaccaattaatatatgacaaattgtatttattttgtcttgtcctgtctccacccacaagaaggtaaatttttcttaggccagtaggcattgtctgcgttaggaggatgatacagaaatcctaacgcagacaatgcctactggcctcaaaaaaatttaccttcttgtaggtggagacagacaagacaaaataagtacaatttgtcatatattaattggtaataaaatgtatattggtcaaatgaatgaaaacaaacaacaaaaacaacaaaaagaagttgggaacctaaagacctatgtttgaatttggtttttttccttactatttgactctgggtccattacttaaaatgtctggtccttagcttcctcatttgtaaaataggaagaaaaatggtatctattattaagacagctgggatgactaaatgacataatttataaaccctctggcatatagcgagtgctcaataaatgtttgccattattattatttgtaataatctgaccgattgttaaaactgtctttctgtgcagctctgagtttttaggatatgggaagaggctaaaagtcaccagtgcccttggcattttcggcccagttgtcctccttgttaactgattaccagttgaatgggtgtgaaagtgctcagtgttcccacctccaagctgctcagaggtcagcattgccattcattgagaaataacaggctgtgagagctcaaatgacttacttatggtccctcaacttaaaaaccagggcacgcaggaaccaagcccagccagtcttgggcttcctaatactgtaatttctctctacagtgtggggtagttaagagcctgtgacttcagacctgtggtcaacggggcctttcaccggccatctcccgcagagtactttttcacaatcagttttctcgcaagcaaaacgtggaaaataagatccacacctcacaagtttgtggccagggtcacaggtgaaaacagctcttcggaaactctaaagcgccggataaataagcgctgcaacaggcaaccacacgcgaacccctttcagctgccagtcccgggactcgctcctgtctcctcccctctccaagaccgcggagtaggaaggaggattaacccctaggggaggagttccgccccccagcccccgccccgccgcccacgcctctctctgcacctacacttgcgctccccaagtctctctcgtgcgcagagcccaggctgcgcttccctggtcaggcacggcacgtctggccggccgccaggatgcaggccccgcacaaggagcacctgtacaagttgctggtgattggcgacctgggcgtggggaagaccagtatcatcaagcgctacgtgcaccagaacttctcctcgcactaccgggccacaatcggcgtggacttcgcgctcaaggtgctccactgggacccggagactgtggtgcgcctgcagctctgggatatcgcaggtgaccgcggggggagggggtcagggggatagagcgcctcgcggccggtttccagtctcgaggcagcggcttgcggccaagcgtgagattaaaatcactaggtcgcgaggcagtttttcctggtgggctggaaacttagtttcaaagaaaagaaaaacgtctgaaacttcaagtgcattccctggcgcttttgggctattgctttagctccttcccgcacagtcccctgggatctctctgcccagagcaggcctccccagggaaccagaggaagattgtctgcaattgcattctgttctccactccagctcgttttctgggcgcgggcagttctgccaatgacgcagcccagtgtcacgcacgtccttccgtgcaggggcggaccgaggggaagcccctaggctggttcacagaggaaaccgggatagttccaggctagctggagtttgcccattcctgtcttcagtggctcactttatttcaaattttgtcacctttctctctgcccttaagacaaaggagtttgagggtttttgttttgttttgtttttttttttttttttgctttttgcttacagtaagccaagtacttttgtgtgtatatgtcaggggcaaagtattctttctccctctctttctgtatttctatctctctggctctctgtcttctatgaaaaggaggttgtgtgtatattttaaggccatttttatgtaagggcctatgatagccttatgatttcttgatttggccctaaagttttcattgagagatctgaaaaatgagaggttgtttgtttttgttttttacaatatttaaaatcagattttgactccacaggtttgtaccagaagttaggcctagtcaaaagtgagggtgcaatgtatctactccaagtgtgaatccttggacaaggctgtttgcaacctgcgcatgaccaacccctcattacagattttagccctgccactaactaacctgctcagtggctttggacaagtctcttcagctcagttgcatcgctgttaagtggaaaggagttgggcaagggtcaaggatcttcctgctcagaagttttaaagtcctctgggattctccatgggaacaacttcaaacagtcttatttcatggtctgtgacaccaggaacctttcgttataagtgctggacccaaactagccacttctgtttcagaaaatggattcattttagctgatgcatttgattggaaactctttatcatggcttgaaactagaacaaatgtggaaaatttttgaaagggcatttgtgatctggggactttcgtgcctctttaatcatgaactgccaggcctttttcttttagcatgtgaacagatgaacagattcatgcatttggagtcatcttcagctgctctagtagcaagggggttatcagagaacagaaaatgttatcagccactgttggatggggcttttcatctaaaaaaattctctctgtgtactttcttgctgcatgtcataatgtctgaaaacccttctggctgctcgaaagtcctcaggattcagatttagaaacggcttactgtttaaacggggatgtagctgtaatttggacttctgtgtacaatccaggtaacagcatgacagcagagaagttctatgtctgtagatttcagtctcctcacataaacagaagagatggaagggtacagtgattaatagcccaaattccagagttgaactgcctccatctggatccttactttactctgcatgtagtaggcaatcttaggtaagttctctaacctccttgttttggtttccttacttgtaaacagggagaatgctttctcccaatagatgacaggtgagcaaccaacagtgctagctgaaggtgatcatgcctgttctctaggagatctgcaaggattattatcacactagctaccatttttttaagcctatataaatgctaggcaagaaggatatgatatacaagtgcttattaattcctaataaattgtgatcccaatattacatatatattttgtccccaagttatcaccattttcagctttgctcctgacatactctcaggagcaatttaactcccaagctcgaaagcacttcgttagccatgttttgtagactgaagttgcagtggaggctgtagtcacagaagtctgtataaataagaaatctgaagtcttgggaagttcattctacagatactgcggtggtgttacattcaacatctcagtagaggagcttgtttttcccagagctctaatgctcagtggtaacctgtctttagcagccttaagcccaaaggccctgttagctgaattatagattggacagcaggcacagtgaattgggtgaaagctaggccactgtaggaaatggttggaacatgcacgtgctccatgtttcatggtttaagctgcatagggagccatgtgggttatgagttcatgtgaaatacaacctcaactgcccacccagactccagtcagccaggtgtaccttatagtactttcaaatcacagcctgtctgtccacagataagaatgcatctctccgtccttagtgttcaactctggtgtgtccccggagagagcaggtagtggaggttagtgggcctagctttgagaaggttgtgggtgttcaatgagatagagaagacctgcactgttctgataggatatcatatacatttgttattaagggaatcttggctcagctagactcttgatactcatttggttcaatgccaaatagggccctttttaatctactaaattcccatgatgtgtctcttatagccatgtagattggccagtctgatcttgaaagactccaaaaagtatctctggggtcttgtgaagtaggccttgaaacaagatgataaatcccaccaaaccccataggggacagcagttggcctggattccagtgattccatgctagaaggtcagctgtgtgttcagaggctcctgatagagtcaaagaaatgaagtaactttgcctgaggccacccagctagtagaggaagagccagatttgacccggttccgtttcactcagagtcaagccttgctgtttgcacttgctggcctgtgagtgcctggcacacagctggcccacagggattatgccttctttttaaaggtgttgtttcattagtaggtgggttaaacttaccttctcctttctaactggatttttggtattattaagtaccactgtgcattcagtgaaaaggaatgaattaaaatctatttctgaaaattttatcttgattaggatgtgaatttatagagtttttaaaaaaataggtcatttagggaaaatgaaaacaaaaagttcacacttgagactccacttttttattactctccaaatccagagactataattgctcattcaccctttcaaaaagaactgtactatcttgtctagaactcttgatgtgctttgggactctgatctaggcattgggacatttatagggatagtagctaatatttcttaagcccttattcttatgaatgtccaggcatatttaatctataatttcccagtataatagctggttaggccactagaatttaaaattgaccattgaatctgttttcaaaagatttgctctactgtccttaatttgaaaacagagcacttcagacatagtttaaatatattctaaatttagatactctgaaaatataattaggcaaactgtgaaaccttgctgaacctcaattgcctcatctataaaatgatgattatttaattttcctgtgatacttattttatcttttgtagtctctgtaagcaaaaggtttattatcactgtcctcagggtataggtagcacatggtcatttattccagcttctttacttactagctttgtgacttgtgtgagttacttagcctctgtgccttcgttttctgtctgtaaaatgggaataataacaatacctgcatcttagtatttttgtaagaattaaatgagttaatttatgcaaagctgtgcctgacacataataaatgctgaatgagtgttagctattattcctgttgtcataattgttattattacagactgttttcacatacattttcccacttgatctccccagcattgctgagggtgtagacaagcagatagtcctaaacccaattttatttaaaaagataaaaaatgagagaggtaagagagttgcctgagatcataagtggcagaggagaataggaacagtcggtctgtttagcttcagcttacttgtatgagtgagataaccaagtctgttggtaataaaaaaacccaactccagttttatattgctatagtggaaaataaattaagttggcagacaatttagagagtgtttcgagtgtttctttgctatgtaaaagtttgactgcagagctctgctaaataacaaatgcctctaaatacttaaaataagatctaccctataagaaaaatatttccactcaaggcacatctataccagcttcccccacctaagccatgtgacatgacagcagaagaatacattaactgtcccatagacaaagtaacaggatgaaggcagcccaggcccagtgtcaggagtccttaaactgactcttcacaccagcaactctgacacttatttgggtcacattgttatgttgttttagagtttgtaaagttctttcaggttgtgaaattcaaccaaagatagggttcggacttaactatctctttagtaccgatttctgaaagactatttcttcaagcagttgtagaagatgggtcttaaatgtcaaagtagtaggtctaggaatgtagaaagagctaaatttggcgatgagtgtgtcaaataaaaccccccaaaatgcatatcgagtctgagccatgctccactgggcagtttattgccttgtttctagcttagctaattacagattttctaaatgccacgtaaaataacatgctatgttcttacgggtaaataatgtgtacagtgagcaaaaatggtgaactttcaaagtaggaatgagggatatatggagaaaacgcctcaaggcaggacatgtcgtgtcatctgggttttagaggactgattctgatagaaaagcaagtagcagcttgaccaaggaaagctaaggcatttgagagtgggaggggattggaaaaagtagctctatatgtgtgattggtttcttcagcaaatatatgtatgtatatataaagtgcctggtatgtgaaagtacttaggtgagggaaaaacaaagaaggataataattgaataagatttacttcttcatcccagcttcatcagcatgatgacacaaaaacaaatcactgtaacaataagtaaagagcattgatagacataacttcagaacactctcatggtgcagagatgttgtccacacctcgttctcctactctctgagactaaatctgaggaagttgacaaaacctcaaggctagtgtgatgtttcttgtgctcttacctagcaccagtcattccctgtgagtgcgtcagggctgcacaacttgagacagaatttcatcatctggccctctaattcaatctcctttgcttgaggatctcatgcattcccagggctttaactctatgcagatgactttaaaactatgcctatatccttgactactcatgagctcaggcttacaattccatcttcctgctgaacatctcctctacaatatctcacctatactgcctgtgaacatgtgcataacaaagtttgtgtgaaaacaggattgttttttctattaataaagtaatatgtgctcagtgtagcaaagctggaaaacagaaaagaaaaacaagaaagaaatacaaacaatgtatgcatatttgcccccacttaatgataagtagtaaatgatgctatttgtaagtctaaactagacatttgtccacattcagtggactttctagtttgtgttaaccaaaataccttacccccagttacttaggcttgaaacctctgccatcttttctcttttgaccctcatatgtcaccagtctccaagtcagatagtacatatgcctctcttttcccactgccatagaccagagacagcacttttttacatacctgttctggatcatagcctcttagctagctctaatctctgcctcctccagttctcaggtgtatcaaagccaaatttatcttcccagaacatctttcttttctattggctatagattacacatgctgtgatgagaacaatggaggggatgagaataaggtattaggggggctgataattagaaaattagaaataagatagatccaagtcatagagaaattgaggaatgggtttgtgaagtccttgaatttaagaagtgactggagtccttgaggcctggtgaagtcaaaaggaaacccaggatgtctctcctattgtggtcttcttgtgaggaacaaagaaactgtcattaagggctcaagtgctacttaattttttttgttttattttactgcattttatataaaatgcagttttaaaacttgaagatttgagaagtataagatcttgcctgagaaactttattaattcacttgataagcagagaaatttaggggtgatcggaataggttgatctttgctcttacggacttttagagtctggtgtggcataaagatatttatttcaaaataattatttagtcattgaaaagtgatctgatgggaaagtatcacatgctaaaagaaagtcaaccaggggacttaccatagccataacatggagatgagaagacatcatgcgggcttcagtaatctgacctagctgaagattacaatgtgtgaggaaggaggtgttaagagggatgcggcagacaaattaggaaaggtcatatatgccaaattaaatgttaagaatggtgaaagtgaaaattccttacatttatcaatttatcaaagcaatatttgcaatttaaataccacagtaattctaacaaataggtcttcttacttccagtttcatagatgaggaagctgggccaagcataagtagaacatgacacctggtacataattgttgcttagtaaaagtggtttggtgttaagcagtcactgaggttcatactaaagccatcactcatctggtgaatttttgagaatagatgttttgagttacacttacaatcctttctctccctcttctgatgattcactttggagattccttgaaagctttcaaaccattgagaagctttatttatgttactttcttagattctgggatgcatattcccagaagaatacagtggacctattgctcctggggtaggaatcaggtttattccagcaagggatgatccttatcttctaggatggtgaattagactgatgtccttcaacttggcaaggtcaagtctgagactctagcctggggttcttaataattgagttttactcattttttcagctgttcaggaatttaagaagttacgtgatcttaaattactctttgaaaataattcggattttaacttctactgttctctccttcctttcattgcccactctcaagtactaattaaattttgtcttttctaccttataaaataaatatctcatccatcttttcaatagccacatcttcttcacaactcaccggaactgttgcagcagttgcctcctgcccatcccctcctccagcttccctgccaatcagtttgtaatcgacagtggtgatacccctcatcatggtgttgttctccagttgatattctcatctgggacccatcactggagccacagcatttttagaattaaaggctgaactttttagcatgacagtcacgaccatcataactgtcactcatttgtcattcagtcttatctctcacatctatgatttttacattccagatatcttacagtggccccagtatacctaccttcccctttatgctgtggctcacacagttgtctctagctaaaaaaaaacaccttcctcttgttaacatagataactcctatgggtccttttcactctatcaatatcacctcctccagaatgtctgttgaaaccatgagactcagggaaacactttttctgctcccataaagttccatgattactccagatagaaatagtttactattgcattggaatgtctttttcctccaaagtgtatccctgggtcctaacatagtatttggacatgtggtaggaactcaagtagtatttgttcaataaagtttttcagtcaactattgtatcaatgccttaattctaagacatatcattgatctaaacatttcttcaataaaaaatagacttctgttcatgattgaaaaacttcacaactttataaacattaatatataaaagtataatttagaattgagaaatatggcaaccacttttcttaaggagacattctattttttttccaaccatgaaaactgggaaatgtccttaaataccattcttaaaagctgtgtttttgcatttaacagtctccataatttgaagtgaaatgtcattcatttggatgtcaaatggcaaaactatatcttttttaaaatttaagcgtatattatataaaataataacttcgtgaaaggtaattttacagaattaaaaccctgagtactcatcaaaaccatatcagtcattttatggatgagcaagcttgatctggaagggaggtgacattagtttctcaggcccacagagcttgttagtggtagaattagaaccagaacacaagattacctggcttattaccaaggaagcttgaataattaaaaacgtattttttaatactaggtgtttgggtgctgtcttcagcattgagttataatgatgatcaaattgggaaggcacccagccctgtggaagttcgtgcagtggagaagaggagataatggcatagcagtggagacacccaaagtcatccacagtttggctttaaatagcatttctaatatcattttctccctccctccatgatgaggtctaaatttcaaccatttgaactccttgctattcctggttcatttccatgcttattgcctctgagcctttgctcctgcttgccctgctggttcatgtctgctggttcatgtgtccttccctttggaagcacatccaaatcctacctgatgtctaagacctatctgaaaaggcagctcctctacagagactttcctagttctctctgtcagtagtaacttcttcctcccttgagtcccatacaacttttctttcccttgtttgtagcacttctctagttaagctttgtgttacagttattttctatctatccaaatttccttcatgatttttagtaaatcctgctgtgagttatttgctgcataatttaatgaaattactgtagagtcagcaaagaagtagagaagaagaaacaccaagaatgaggagaacctagcaagggcaggcttttggaagcaagaggtagataatttaataaaaggatagttaatagtttcaaatgtgttatgactttttgctctgagtctctactttttgtagtttgtgttattctgatgtattatttaacctttgttccttatcacttttatttaaatataactttcaatttgtttatcagccttgcataaaactgctcttttaagaagagtaatgaaaacttattgatttaaattatttttggttagactgttttccctataacatgctataaatggccaccaattattaagtgtcaggcatagttttatgcattcatatgcattattttatttacagctcataatgagcttatctgatggacactgttattaaccctactatagagatgggagaactataaacaggccagaaaaaagataaacaagctaacaagcacagaaagcttttcagaagtcttaccaatagtagcaggtcatgctgggatatgcactgagatttgtctaactacaaatcctattttctagccatgctattctactgtttcctgatgcattataaacagcataatggtttttacatctcgtgggttgttatacattgcttttagaaggtgctcattatatattttaaaatagtaatttattaatttttaacctgtatacttttggatagacctaattattgaatgagttgaattttttgcatgcatcattgctgacaccatatggttggtttgacttattaacagtcatcttcatatactacttttaggcaggaaaaccactgtgcctgagggacagaagtctctagtttacaaattaaagctaagaatagctgtagtgcttgttggtatcagaataaaaagatttatatggtggtagaaggatctgtatgcatgtattgtgtggtgtgtgtatcttaaattaaaaaaaaaatacactagactctagaggctacagcgcaagttctcaaactttctcagttcaccgcatccaaatccttagtgttttggattttttcattgtgcctctaggccaaaagcactacctaacaatcctgttcattaaatagcaccaaacaacttaataagtgttataatagccataagaaaaaaaaagagaacgcataaattaaaagaaaattatttttgtttcattgttaatcaccacagtttactataggcatgtgtatggctttggtcatgaaacaccctctcaaacctttgagccggagtggatgccactaccataccaccgtcatttcctgtttcacattgattttcacatgatttttgcttttcatcacagaaacttccaaaccccagtttcaaacagatataatgacatcaaaaggaatatagtgttaacactgtgaactacctcaagctaatagttcctggggtgtctaatggatcttgagtactaccgtatttgccttgaaaatttaaaatatcctgtttcacccatgtgagttcaccatggcacccccccccaccgagagcaccttggcatatattttgggagttataactgtagcagaatctggatattccttaagagtgcaacttttagagtccaggatctcttgggggttatttataaaaatttatttaatggatactgactggtattgtctcaaatgccaaataattcaaaaataggttttttatgtaatacatttgagcttacagttcagaggtattttaggttgtttatttgattataaacatgagatgctggtccttctgtcttgattcactccaacctgtcatccatgacttggtttccttccttccccctgctttatccactgttgcaccttacattgctagatgatctttttatctccatccacatgagttatttgcttaagctggtagcattgggctccagtctaaaattattctgacaaaaaatctgttgggctactgtattagtactcattttcacatacacacatatatatcacatgcactgctttaaatttaaatatacattcagaatttaatgagaatactttcgaaaatgtatttcaaaagtaggtcactataatccatccatcttttgttctataaggtaattatgaacaacaataaagtcaatatttaccttttatgccattttattctcttgtccactttagcttacttaattcaatatacttcatctagctttatcttcttgttgaatagagacaaaatttgcctttaagagatgataactaacagtagggtaaaatgagagccattgtttatgggggaactaaggaaattgctaaaagagtttgggtggttctgaattatgaacagatatttttcagatgggatcttaaaaatggcaagttcagtaggcataaaagtaaatgagttagatcaaagatcttcttttattcagcctacaccttttcctgctggggttccctcttgcaaataagaaataagtattaattgttatttcattatgcaaagagtacttgtattgctagttccattctattctggaagtgcattgtgagcataaagtaacagcctcttagggtacctgtgttatggagacaccgaatatagtaattgagtaattctacactggactcaaggaatctacagtgtaattgaggacacaggctgcacaggtttgcagcacataaaaagcagtacaaggcagggcctgatcaaatggttgagcgaatgatccagttagtcagtgctgtgggaatatagaagagtgaagagatgagtgtgagtccaggcagtcataaaagtctccaagaaggtggagcttgggtacaaccttaaagaatgggtagaatctggttaggtgaaggatgatggagaggacgtctttcagtgggagtggatttgccatggtatgggagtaaatggaagcaagaagcagaacttagcagagcctagcaaggcataggttgggtcaaaaccttgacctcagtctgaaaattagcctttaacttgtagatctaagagtgcgacctcagaaatcccacaggaggtcagagggtggaatggaatcatcgtgaaggcaaggatttttttctagttatagaacaaaactagtaaccagctgtatgttctagttatatgttcctagtgataattctggaaaattatagggattaaatttttttttgttaaatgaatgaatgagattagacgagatgaaattagacagtcttagctaaagtgattttagtgggagtggaaagaaagtgatgaatgcaacagaccagacatgacagaaaactcttaaataactaataagcctgcaaatccactgggagaggagtaaagaattaagaattattccttcactcagcatggggaccatattgaatgcttactatatagagtgcagtgcttgtcacaggggctgcagaaatttggttctggctatggggtggcttgttattttgtaggggaagattgtaccaggtaagttctaggatatacacctaggtgacttggaaaaatggtaattaatttatatgtttctgtcattggtttgatgggacaaagtcatgaaaacagatgaaagtgtttctgaaccaccgccagactgtcaaataggcttttattaaaaactggaaataaccaccatcactaggatgtcagcctgactctgatttcagtatgtgggtttccactgagctttcaaaaccagcacaagccattatgatgtcagtgtccttttgaccattgcagcaattatagtttgatttttttcttctagattattgtgcaaggtccatatttactgttgattatatatttactttatgttttccacactgttactccctagaaatatagagaacatcttggtgtcactcttaggtctactgatggttctgtgaccccaacacatgtatcatttagatagagtaaattgattccaaggtagtatttcttaagaaaatgagaatgattatgaaagcataataatccaggctgaaacttgttacaacagatatgcacaataatgttaattttctcctccaataacaatctattgattatttactggaagttggagttgagtatagagtaagttcatcagtatgcagcactaattcacaaatacatgataaggcattttagaggaagaaggagccttaatttgaatttatttccaccataaaatcttgagctcttattgtatcctaaaggtggagaaataagcctcgggttttgcaatatcgaaagatggtcaatctgctctccaggattttcagtgccatggttagagatccaagcatgaatgcacagcataataagtgtcagtggtgtagaaattttaaaattctatgggttcataaagaagagattcagtgattccagctgtcaggacagggaagtatgcacaaatgtggtgagatttaagggcacatttgaaggatgtataggattttattgaacagagtgggagtagagatgaggagggaattcaggctttgggcacaaagatttaaaaaggcaagaaaatctggaaagtaatttaggatgcgttttaaaaagaacaagtagtccaatgggacttggccatggagcactttgaaggaagcgacaagagtttgaaaaagtggtcggaaccaaaaatgtgctacattacatgacatatcaatgaaggtgtatttttcttgggcatataagagtcactgaatagctaaaacagcagagagtaatggtaagatttaccttttgatagtggattctaatggagatagaggttttcttttcttttctctaaacttttattatagattcagggggatacatatgcaggtttatgacatagacgtaggtatattgcatgatgttgagctttggggtacaaatgatccccttactcagggagtgagtatagtacccaatagtttttcaacctttgccccttcttttcttctcactccagtagtgcctggtttctgttgtcattatcttcatgtccatggttacctgatgtatagctcccacttataagtgaggacatgcagtatttagttttctgttcctgcattaattcacttagggtaatggcctccagctacatctatgttgctgcaaaggatatgattttattctcttttttggctgtgtaatattccatgatgaatatgtactatgttgtctttaacaagtgcaccattgatgggcacctaggttgattccatgtctttgctattgtcagtagtattgcaatgaacatgtgagtgcacgtgtttttggtagaatgatttgctttcttttggatatatacaaaagaatgggattgctggattgactagtaagtagttctgttttaagttctttgagaaatctccaaactgctttccatgatggctgaacttattttcattcccactaaaagtgtatatgcattccattttctctgcagccttgccaatatttgttgttttttgactttttagtaaatggtaaaccattctgactggtgtgagatggtatcaaatagtagttttgatttgcatttctctggtgttcagtgatatgggatattttttcacatttattggctgctcatatatcttcttttgagaactgtctgttcatgtttttgcccatttttttagtggggttgttttctgcttgttcagttatttaaattccttatatagtctggatagtagacatttgttggatgtgtatttggtgaatattttctcccattctgtagattgtctgtttactctgttgataatttcttttgctgtgcagaagctctctagtttaattggttccacttgtcagtttttgtttttgttgcaattgcttttgaggaattagtcataaattatttcccaaggctgatgtccagaatggcgtttcctaggttttcttctaggtttcttctagcttcagatcttacatttaaatcttcattccatcttgaattaatgtttctatatggtgaaaggtaggagtccagtatcattcttctgcatatggctaggcagctatcccagcaccacttattgaatagggtgtcctttccctactgttcagttttgtcatctttgttaaagatgagatggctgtacttgtgaagctttatttctggtttctctgttctgtttcattggtctatgtgtctgtttttgtaatattaccatgctgttttggttacagtagccttatagtttgaagttgagtaatgtgatgcctttggttttgttctttttgcttagtattactttggctattggtcttttttttaattccataagaattttaggatagttttttctagttctgtgaaaaatgatgttggtagattgataggaatggcattggatgtgtagatttttggggggcagtgtggccattttaacaatattgactcttccaacctatgagcttggaatgtttttttctttgtttatatcatctatgattgtttttagtagtgtttcatagttctccttgtagagatcttttaccttcttccttggttagatgtattcctaggtattttattttatttttatttatttatttatttatttatttatttatttatttatttattgctgctattgtaaatgggattgtgttcttgatttggctcttggcttgaacattattggtggatagaaatgctattgatttttatacattgatttttgcatcccaaaattttactgaagtcatttatcagttctagaagcctgaaattttactgaagtcatttatagttctcgtagtcattagggctttctaggtatagaatcatattggccataaagagagatagtttgactttttgttttcctatttggatttttttatttctttctcttgcctgattgctctggctagcacttccagtaatgtgttcaataggcacaatgagaatggacatccttgtcttgttccagttctcaaggagattgcttctactttttgcctctttagtgtcatgttgactgtgggtttgtcatcgatcactcttattatgttgaggcatgttcctttgatacctattttcttgagggtttttattatgaagggatgttggattttatcaaaagctttttctgagtctattgaggtgatcatatggtttttgtttttaattctgtttatgtagtgaatcacatttattgatttatatatgttgaagcaaccttgcatccttgcactatttgatcatagtgaattcactttttcatgtgctgttggatttggtttgctagtgttttgttgaggaattttgtgtctatgtttatcacgaatattggcctgtagttttcttttttcattgtgtctgtcagattttggtatcagggtgatgctggctttctagaatgagttagggaggagacgcttcctgattttttgaaatagttttagtaggattgataccaagtcttttttgtatgtctggtagaatttggctgtgaatccatctggcctgcaactttttggttggtaggtttctttattactcattcaattttggaagtcattattggtctattcagggttttaattcctttctgattcaatattggcagattgtgtgtttccaggaatttattcatttcctctaaattttctagtgtgtttgcaaagaagtgttaataacagtctctgataatcttttgtatttctgtgggatcagttgtaatgtcacctttgtcatttctgattgggcttttttggatcttctccctttttttctttgttaatttagcttgttgtctattgatcttgttcattctttcaaagaaccgacatttgctttcattgatactttgtatgtattttttgagtctcaatttcattctgttctgctctgattttagtgtttttttgttctgatgttagattgtcaatttaagatctttctaacttttttaaattagccatttaacaccataaactttcctgttaacagcataccagagattttggtatgctgtgtccctgtttttgtttatttaaaagattttttaaaaattatcctttattttattgtttatccgaaagtcattcaaaagcaagttgttttcatttccatgtaattgtgtggttttgagagatttcggtaatgctttctatttttattccactgtggttcaagagtatgattgtatattttcaatttttttcgaattgattgagacttgcttcatgtctgggcatgtgttcaatctttctatgttctgtgcaaatgagaagaatgtttattctgtggttgatgggtagagtattccgtagatgtctgttaggtccaatcagtaagtgtcaaattcaagttcagaatttctttgttagttttctgccttgctcatttgtctgatactgacagtgggatattgaagtcccccactattattatgtggttgtctctgtcttttcagaggtctagaagtacttgttttatgaatctgactactccaatgttgtgtgcataatatattcaggacagttaagtcttattgtcgaattgagccgtttattattatgtaatggcctttttggtcctatttgactgttgccagtttaaagtgtgatttatctgacataggaatgacaacctgggctcttttttgttttctgtttgtgtgctggatctttctctaatcctttactttgagcctatgggtgtcattacatgtgagatggatttcttgaagatagcatacggatgggttttgtttttgtttctgacttgccattctgtgccttttaagtggggagcttagaccatttacattcaaggttaatatttatatgtgaggttatgatcttatcacgaagttattagctagtttgctttgaaatataagtttctattgtgtggttgctttatagggcctgtgggctacgtacttaagtgtatttttgtggcagccagtagagttttttcattgccatatttagaactcccataaagatttcttgtaaggcttgtctagtggtaacagattcccttaggacttacttgttttgaaagatttttaaaatctccttcacttacgaacttagtttggtgggatatgaattttctttttttttcttgagacaaagtcttgctctgtcgcccaggctggagtgcagtggcatgatcttggctcactgcaacctccacctcccaggttcaagtgtttctcctgcctcagcctcccaagtagctgggactacaggtgtgtgtcaccacactcagctaatttttgtatttttattagagatgggatttcattacgttggccaggctagtctcgaactcctgacctcatgatccgcctgcctcggcctcccaaagtgctggggttacaggcatgagccactgcacccagctgggatatgacattcttgattggaatttcttttctttaagaatgctgaaaataggcccccagtctcttctggcttgtaaagtttctgctgagatgtccactgttagccaaatggggtttcctttttatgcaatttgacatttttctttagctgcctttaagattcttttctttagcattgatcttggacaatgtggtgactatatgccttagtgatgttcattttgtatagtatctggcaggtgttttctggattttttttgtatctaaatgtctacctctctagcaaggttagggaaattttcttgaattatccccccaaatatgtattccaggtttttaaatttttcttctctctcaggaatgccaataatttgtaggtttgatatttttacataatcccacatttctcaaagactttcttcatttaaaaaatattctctttttttatgtatgtctgactgggttagttcacaagaccagttcttaagctctgaaatggtttcgtctgattggttcagttttgttgagaaagctttcaattgtattttgaaactccttaagtgaattgtccaattctagaagctgtgattaattactttttaagatttatctcctccttcattttctggactgctttagacgtttcttttcaatcttatattggatctcattgagctgccttgcaatccatgatttgaattctttatctgtcacttctgagtttctattttcattagggacctttgctggaaagctagtgcaatcctttgatggtgtcactgcattcatatttttcatagtatcaggatttttgtgcttgttccttttcatttggaaattttggcacttctaatttttgtaattattttcatgtttgtaggacttttttctttttctttatttctctatcatactattgctatttttttctttcctttttccttttcctttgccctgctccatggggtcttttggttttgcttctgtagccttatgtacttctttctgcaggttttttattgggctgtgcagtttgacctgtaagtcagtagatagtgcttatgcatgatagcaggctgtggtcaatgtggctaggtgtatacttgatccttgtttactggcggaagctctctgttgcctcaggcaatgggctgattcttggaacgcacagtggtctgagctccctgcttagccaaggggattggggtccacaatgggtggggccagaccaggtaggttcatctacaggtgccctaatggcaggtgcaagcagctgtgctgagggagaatctggggggcagctaccaagtgtgagttgtgtacctcagcatcaggttgggaaatctcttcagccgcaactgcatgggaagagtagccgcctataaacccctaatccaagagagtaagtgcttcagatgcctagagagctgcctggatgtagagcagagaggctatccttgcaccgcaatctctgcacaggaggggtgggatggctcaggctgccaattcaggtgaggtggtgcttctaatggctggatatttgcctgggcatggagcagagagtacctttttgcctcatggtctatgttcaggacaggtgtggtggccagatgagcaggtgctttgaatgcccagagatctgccctggtgtgaaacagagttagcctcccagcaccaggctgactgcacaggaagactggtgcaggtcagactactgctccagctgaacaggtcgtctgaatgcctggatatctgcgtagccatggagtggagagggacttgctgtaccacgatctatgtctgtcacaggtggggcagctcaggctgctggtccaggcaagtgggtgctccaaatgcctggatttctgcctgggagtagagcaaagagggccctgctacaccacaatctcaggggagcaggctggacacctgcagtttggttccagatcgccaagctggccctagctacaagtattactgcccagtagaaactgcagctttatcagccctcctcctgtcccaaggttgtgacagaggagaacacacttctagcacctactgctgaggggctttccacagttctggttgtggaggctcctatgcagctctagagtgagtgctctggtctctggctagagattaaaatgaatagttgcctttctatgcactcggattaaaaatggcatcctgatcttggtcctgggtctgggaaaatgtctgcagctgttcctcacgtcttttcctcacaatgtctccaagaaactccacaagttagctctagggcttgggagaaacaaagtgctttcccttggcatgctttgctgggatccccaatggaaaggcaagtcacagagggaggctctctgcctctctcacatacctgagcttctctcacttttattagctgaatgccatcaaagcggctgtttgcccatgttccctccctggaatttggggtattcttcaatttgagttgtcctggtggattcccattttccttcttgatataaagcccacacaattggtctttatgcactatcttgctatttccatgtggctgaggcatgctaaaaggctctaatgtactatcttggggggaaaaaaagaaatagcagttttaagactaatcatacactaacatcacttagagatggcttaaaaatacaaattcctgatctctgcacaaaaacaacacaataaagaatctctgagaagtgcaacccaactagggatgggtatttcttaggtgtcagaggtgatttcttatgctgccagaatggcaactacctgaagacttgtgcttacatttatgtttatatttggggagagagacattgatgagagcctagatactgagatccccatttagggagctgccaggggtccaggtgaggagcaatgaggggctgaggtggagcaggagcagtgctgggggagaggaggggcagagccaagggctacctctgaagtagaagtgttagttggatactggagcctctttggttgaaggagtgaggagggagttagaagatgactggaagtaaaaatactgctagatatacattttagctgtgatgtttgtgtgtatttttagctgagtctatgacaccaagtggaccatttcaggctgttgggacagagggccaaagtttgatttaatctaaggcatgagcaaggggcctttgagatcagccacaccaagttcattttatagataagaaaactgagtctcagggagagaaatacatgtgtctgagcctgttctggtaaccagtaagtaaaattaagaccatgccttctgacttttcaagttggtgtcttctgctgtgagattatctaaatagttcccgcagccattatattaacttttgtgatttggtttattgctttcctatttaacacccttcatagctgaaagctgaatcatgagccacatctacactgctatgagtttaagagcattggggacctatgtggaagtggattattttcagtgcagtaatccagtgtgacaaaacttagtttagaaattcctcctgggcaaaaactgtatatttccagcacaaagtatagagctttagccacattagctattccataaatgtgtgttgaataagtgatctaaaatcaagggaagtttttgaattatagtcatttttttaaaaagtaaatttaactatgatgaattcatcaggtctctactttgcccaaaagtaggcactcactctgagtcacatggttctcattctttgaataagaaagagcaaagaggactgtcagctgacaaaggaaggagaaaatgtgagtgctagaaatgctctgatctaagtgtgacctcttgctggaatgccaaaaatataaactttccaagtggcctggctcagtgacctgaacatataaacatcttttctttctagaaacaagctgtcttcttatttctgatctgacacacatacattcacaaactcaaacacacacacatatatatatacacacacacacatattttcctttttgattctctatgaagttatagcctatgtattgctttttgtatggtcttaaaataactctttatcatatatttaaagtgcaaaatctttattcttgaggactgccttgttctactatgaaaacctctggacaagcagattattgaataacccatgactttgctcttcatctgattagatccttgaaagagatcataagacatcctttaaaagcctaaaggccttggaagttctgagttatcacagaaggcttttttcccctgtttttctgaaatgtcatggccactctgggcagtatcaaaggagatcactgtttgcaccaggtatttaaaaagaaaaaaagaaatttaaaacttatttgggaaaactaaaagttcatctggggcttacgtgtcatgtggacagtattttgcccctttctttcgttgactaggcaactgtgggataaaaaaatgcgtctctggtataacccacgtaagaaatactgtaagattgtcatgtgctggctgtgacaaaatactctttttttccagtgatacttgcttgtgcacacaggctcacacactgggaccagagccctcgaccttcattcattttcactaagtgtttagagaggcttctcttacagtttcaatgctactaccaatgtaaatataaccatctacaaaacagcttgctaacttgaattaaaacttaccattataaagtttttagctcaaaattaagggtaaagtgttcttcttagagatatgttaacctatattttcctagatacatcccagttttagcattttactctttccaagaaaagtcgacttgttaaatgcacactaactttattttaatttatataactttataagactcttaacataaataaattcccaaatcagaataaaaaggctttgtctggtcacatacttctggggttttgagttcagaaaatacaagtcttcattagctcctgtcttcagcaaccattaatagacagagttagaagtagtaggattttgttcatttttgttattcagctgaaatacttgtaatttttttgtcacaaactctgatctgaaactctgatttcagaacttgtgccatattgtctttcacactatttaacatgctgccaaaagagaaggaaaactcaagtataaggtactatgctgggtgctttgcatatattaattcacttcatccacatggcaaaactctgcagtacatattattattgccaatttgcagataaggaagaataaacttagagtgcttaagaaacttgacaatattcaatcagaacgttaagcatcagagcaaaattgattccagctgattctaattctgaaaccaatccttatcctaaacaacaacaacaacaacaaaacttatttagtgttttgctgtaggagagcttttcttatccaataggttgtagagtatttaagggtagagactatctagtttactgttacattctgagcaagagtccagaaactggcatcgatataatagatgtccaataaatatctgttcagtcaaattcaaagggatggtcctctggtcctggtatctaagcctgcggaagagagagtacaagcctataatttagtggttgagagtatttaatgttggtaaaagactgtgagccctagattcaaacagctcaggtttgaattatgatttcttaagcttactatctgtatgatttgagaatgttacttagactaagtttcaattttctcactttaaaatgggggtaataattgcaccttaatgatcacttatgtaaatcacatttctcatggttagtaaacatgaatgaatggtagctagtattataacctttaattggactagattgtggatcccttttaaacatactccataattttgttatttattatgtttattgtttagagtctgtcttcccattaaaatataatcttcatggtggcagggatggttatgttttaatcagagtatcccaaatatttagaacagtgttgcccaatcgaatgttctatactgatggatatgtttcattattggcatagtctaatacagtaggcactagcgacatgcagttactgaacacttgaaatgtagctagctagggtgacagaatacttgaattaaaaattttgtttagtttttgttcatttaatttaaatagccatatgtggctactggaatactgtatttgcataggtctagaatattacatggtacacagaaatttctcagtacatatttgttaaatggatgaattcccttctgaattcaaaaatcaagaacaagctacatgattgcatatttagttcgctctttaaagattatcagtaaagacgaagcactttactgattgacttgctcatcttggaggcttcatgaagttataatatgattcagtttgcaattttaatacatttttatttttatttctttttggtgtcaggtcaagaaagatttggaaacatgacgagggtctattaccgagaagctatgggtgcatttattgtcttcgatgtcaccaggccagccacatttgaagcagtggcaaagtggaaaaatgatttggactccaagttaagtctccctaatggcaaaccggtttcagtggttttgttggccaacaaatgtgaccaggggaaggatgtgctcatgaacaatggcctcaagatggaccagttctgcaaggagcacggtttcgtaggatggtttgaaacatcagcaaaggtaatgtgactttaaataataagcttaatataagcaaggttcacaaagaaaatggcacataatcatcaccatcatcataatgataataatatgtttgtttagtgatgtatggttttcacattgctctaagctctttctcatctcagtgcaatgagtaggtaaggcaggaattattatctacaatttaagatcattgtggcaagaggaggaaagcaacttgtacaaggtttcaatagtaatagttgataactatgtttgccttttgaggtcttactatgagccaggcatattttgcatgcattttcctatttagtcctcaccacaactttattaggtgagtatggttttatagtaaaggccttattcatgtgttagttaatttacacaatcaatatttaatatgttcacctgtacatcaggaattgtgcttcctcctaggaaagaaaagatggcaaacactacattgggcataccggaatagtggggtaacagagaatagacagcaagcacaaatgtgaagaacacagcatagcttggccatgctgtttcccctggatggcagaaaagtggcaggaggtggagctgaggcagggctggaagatgaaggatcctgtatggtgtgatgaggataatatacttctcattgttccctcatgttgccatctgatatgtcaggttcctggcttttgttctactctctttttgtttttgcctgtatttaaaaaatctcagtatcacaggagaaaaaaaaaatactttcatggcaaaatttgaaaatccataaaaaaccataactaaaattttaaaagaataaccatttttgcttttgatttttgtgtgtgtgcatataattacactgttaggattgcatttcacatggttttatatcatgatttttccacttttattcaaatattaaatgtttgtagagcacaggtactacgctagtttttgggattcagctgtgaataagatagccatgggctccgtacttatggagttcacactttggccttatagtgagcatttgtgcacctcattagcaaatggtttgaaaatattgctggaatggtcatcattctaataggctgaggaggaacctctaatgggttttctgctggaaagagaatggtccagtttgccttggagaaactatagaagacggattggagggcagtgaaccaggagacacagtggcatggtagttaccatgctctgtgggaacataatgagaccttaaactggagtagtggctatagataggaaagaaaacctggatttgagaataccaccaaattacaaagaccagcacaattaagcaagcacttggattggagttgatggagaggaagaaaagggcagtggtgccactttttctgtcacagtgggatgttcttttgtttgaaccattcctggagagccttgatgcctgtctccttgctcttctgtcactagcttttatgtttggaaagttgttattgctcagttgcgagagttcttgtcttccttttgagaccccagtatgccagtgtgcttttccctttcattctatttaaaattttgatttcccctgtttcttgggattcttcctttggttcaggatacatttcccatcattttatatttcttgactctctttgaacgtttttagtttatgtggttgaaggatttcttgctgtaaggggagacagcacaactgaaaggtatgattaagttacagaaatttaacaagcatggtatctttttgtagtctattttctttttttgtttgtttgtttttttgagacagagtctcgctctgtcacccaggctggagtgcaatggcatggtctcggctcactgcaagctccaccccccggattcaagtgattctcctgcctcagcctcctgagtagctgggactacaggcgcccgccaccacacccagctaatttttttgtatttttagtagagatgtggtttcactatgttagccaggatggtctcaatctcctgacctcgtgatccgccttcctcagcctcccaaagtgctgggattacaggcgtgagccaccgcacccggctgttttcttttttgaatgttggctgttttttttttttttttaattccaaaatgtgggtaaattcacttattttcatttccttttagcgccacactcaatttcactccaaagttgctgcgtgttccttcaaattgctttctttcaaaaaatgtcactctcagctcagaagcctccaggcacaagggagacagagtaggactttgagaactccttttctctgttgattacattacattgtaagtgcaaactaggctgaatgacctgtatttacatggggagaggagtcttctgttattcattcattcattcattcagtcaataaatattatcaaatacctgttacatgccagacaaatgttctgggcactgagaatgtagaaacttatgaaacagataaaaccttgccttcatggataaaaacaacaacaaaacataaatatatgatgtgtgatacttattaagtgctaataagaagaaagggaaaaaagaaaggaagaggcctatgaatctgtggggaagcttgaaattacccgtgggtcaaaagaccttctgaagacatttttcacctcactctgacattccttgctcaaccactatagtgttaaactgcctgattaaggacacaatgtttagtacctttaggactggctgacccaccttacttaggtactggatttctaatcctccaaatccctctaagtgtgaactttgaagagaagctttgtacggtgttggggaagggggacatgagatttcacaagctaatataatcaagagagtacaaggccttattgtaaaatacagaaggcacgttcaacatctcttttccatacctaatgctattgaggttgtccttctgaatgtcttaacgaaaacggcttgcctgtgccaggttagtattcaaagtcaacactgagaagctcagaaacaatcctgcagcactgacaaactggagtgtcaaacttctttaaaattctttttaaagatctctgataaagctctgctaactttctgactatagtattacaacatttacaaaactgaggcctagattaaactgtctgcctgaagcagagatggtagattttggggatagctatgaattccttccttcattttgagatcagagaacatttcccataggtatccttcctttagacagtcaatcttctaaaaattagagtccttttgagtgacgacataatgtctggtgataaatacctgatttcctttcttcacattgctgaaacttctgagtcaaacttctggctttgtccccatgggcacatccagcagaaatccttcaggtatcatcatcagctttgacatctctgcagttgaaacttgcaggattttagatgagttagtcattgaaaccagcctccatcttaccactgaccccactgctgagggaaatttaccctcttgctcttcaatcctatggagtaactttccatgagagttttcatgactactgctgttgctggagcaatcatggtagcccctggctggcaagtgaattaagagagaaaaaataaaaattaaatacatgttggtgtctctggtttttcacattatctcttccaatattaaaaccaaaggaaagaaaatagtcttttctgcgtcatattctttggtttttaacctttgcattcttttgctttcttggctgtatttccttgaattctgtctgtggattctctaggtgatgtataattggggtaatcatgtgtcccattttgccccccaaattcctggtttatacctgctgttccagcataattattaataataccttcatttttaatttgtaatttaaatttacatggtcaccctgtagatcatgagctcaacttattttactctctacatcataccttagctctaataatggatattttagtattcctgtgcccatatcccatttttataatctgctttggcagatctgtttctttaggataaagaccctgcccttctcttgttagtatatcttcagggcccatttgagaggctgactgggttctgctacctgctgaacaaattacctggtacattcttggtgcccattgcctgaatctccatcagttgctgtttttgaattcactctgtaaaatcacacccactcaccttctagagctactgtgaacattaagagataatgtggctgggcgcggtggctcacggctgtaatctcagcactttgggaggccgaggcaagtggatcacgaagtcaggagttcgagaccagcctggccaacatggtgaaaccccgtctctactaaaaatacaaacattagcaggctggcagcaggcacctgttaatcccagctacttgggaggctgaggtaggagaatcgcttgaacctgggaggcggaggttgcagtgacctgagatcgcgccattgctcaccagcctgggcgacttgagcaaaactccatccctacccacaaaaaaaaaaagagagataaataatgtatgtggggccagatgcataatatctgatcccaccacatgtagacacacactttgcacactctacaccattcctactgtctctacccacagcccatacgccgatctagccgtgatgcacacaacagccatactctggtgaaaaggtctgtttctgtaccttagctctttccagcctgctccattctgctcacataatggagtggatcaggtgtggctatgctcagaaatacaccaccacaaacactagtgtaggtgggaaagaatggagcaagttgtacctatgcaatagtggggacaaaagtcaaactcacagaaagaacctccagtgcttccagctcttgctcccctaccccagtcctactcctgacagatacccttggttctttctatgctatttatagtgactttttggacccaccctctctcccagaatgttctaagagcaacaggtgccctgggaagaagctttcttacgttaaattatactcaatttttgcctcttctttgaagctaaaaataaaaatgttaatgtgtatccttctgctgagaaaaggaatatatctaatactgttctctataagatggtattagtttcttttagggagaggaacggatgtttcacagtgtagtggatatttctcatgttgtttggctttctaacaactgttaaatacatttgctatcttcggggaatttccagccgtaggaagctcacctctccaggaagaactcaggaaactttcttcttttgcttcctttgcagctaggcacaggcagatgacctagattccaccaattgtaggttgtaggcatccatctccaaataatttagatgaagttataagatatacctccactgacttaatttgtcacagcacatttaaccctgtatttttagctgatctgatttgagctcgttatacttagggacataaaaggaggggtctgatttgaaatctaaaaccagagcaaactgagaatcataatatacaggaaatgatggctgtgtttaatagtgatttcacataatgtccaccagtctgtagtacaactatttgaatcatcacttctgacagattattgatgccctacatgaagaatgaaaattgttttctgaagttgggaataggtgaagtgtatgagtctcaaattcaagctagttatctatttaaggatcaatataaattaataacaatattttatctttagctaatcaattctctagaggttccctacgtcaatgcttataatttactagacaatctgagatccacccgtgactaagatactgtataataggagaatagaaatgaacgatcagaggctataaccatagttcagtttgtagaaggcagggtgttgcatatgtcattctattctgcatggttcgtattttcactacttagagctcagatctttcctgtttcatgtttggacaatcataataacctgactccagactttgctcaaagtcgtgttttgcatgctattaaaaacttaacctgctcaaaggatgactttgattttgccactgcctagttcaagaatcttctgtaggttctacttcttaatgatttaaatttagacaccttagaacatgcattagcaaactatgatctgtgggccaaatatggcctgccctgtattgtaaataaagttttgttggaactcagctgtgctcattggtttacatgttatcaatggctgtttttatgttacaactacaaagttaaacagttgtaacagagaccttatagcctgcagagcttcaattatttaccatctgaccctttatgcttcaaagtttaccactgatgtctcaaaataagaataacttctctttagccaaccactctgctagtggctttacatacattttagcttatccttgaaataatcttatacagtaagtactgttactttttctgttcacagatgaagcaattaaagtttaaattagagagtgactagctaaagatctcattgcggtatgtcaaagagtcaggatttcaagctagatgtgctgacagaacagcttagccacccaaccaccacattgcactaccgtataaccttttctagtctgaccttatataataagtatttattgagcaattgatacatggtagaccagggactgggatagataaatgagtaaaatgtggtcctgatctctaggagtttaaagtctaatgacaggtatacagatgtgtaaatacgtcttccaagaaatgtgacaaaatggagcaattcacatggaattgttgggtgagttggataagggaaaggccttttctcacatatacttttcgtctagccgttgtcagaactacctatctttttctcatctttctgcttttgtccatgttggtcacgctgtatgggattataatgcaatggacattctttgtctgtatttcattttgcccaacaaagtccagctctggatgtgagagaagaaacatagaaaaatatcctggcttcaggagtcttcagaactcaaattagaatccctgattctgatactctgcccccaacaaataattcttgctctggctaagtattaaccctttcttcaggaattgcctgactccaatacatttttctacagatacctatggaaagggacttaagcaattcatgacaccatgggctggctgtaaaagaggatccatgcttcagtgcataggatgctctaagaatctcttgaaattatgtgtgcaactttaattatttgtagagagggcaatcatttattgcatactaagaaccttccaggcatttcacagctattatcactaattcctacaataatgaagcattatccccgttttccatgtggaggagttgtggtatgattaagggacttgctcaaagccatgcatgcagccttgtgtcatgattctgacccctagctatctggtaaaagcccacattttccatgatctgcaaaagtgtttccatgcttctcagcagtctttctcagattcagaattccttgtgaccctagagctgagtctagttgaggacaggcctgtttttctgaggtcagaaggatgcagtcactcagagagctatctacaccatggcctcatctctctaggcaaggaccatccatcagaagagagggctgaactgtactatatgagctggcctggcatatatctatctcctaggtagtaccaggcatgttggttggagagaggacagctcttgaggaaacctgtagaggccatatgatgtatgagggtaggaaggtaggaggggaacacagacttgtaaaatctgtagaatttccaaaggcagagatggaaggagaaaggtattctaggcagaggaaacagcacgtgaaaggcatggagttgagaaataacagaaagtgctgacaatgctgaggttcaatgaggctgaaggataaggtggaggggaaacagagagcaaagctttgcggtatgtcaaaccatgtccattagcataaacccttccagctgagaatcctaatggactgtagaagtctgaactcaaagattcaacagtttcttagtaatgtccaaaaatcaaaggatgaccatatttgatttttattaaaagacaaatgccaactaaataacaactcttatgaaattagtgccttttccttagaaaatttggcaaatcctaatataaggcgtagggtttttcaacctcagcactattgcatttggggccaaataattcttagctgggattgggagggaagagtgtgtgtactgtgcaaggcaggatatttagaatcattccttgtttctacccacttaagatcagtagcacccaacaccccaatcagttgtgataatcaaacatatctccagacattgccaaatgtcctctggttgcaggggcaaaatcactccccactgagaccacaattaaacagtgatcaaaaaatatgtcttgtgcccagttggttctgctgttttctagggggtggggacagagtcaggtctgccttgattctatctgagaaaaaagaatacttgtaggcctgtttccatgagtctgtgggaggaagaaaacatctagaaagtaaggcatgttgtctttgagcctggatctttcctccttgatctctatctctagccatggacttgtttctaaaacttcagacttccatatccttctggatctctacttggatatcactcagagaactcctcaaacccaacatatctgaaatggaattcatcagcttttctggaaatataattatccaatttggagaccctacatccatacagacactcaagctggacaccatataaccaggtcacacattctttagaaacccctcattcttgagcatagaagactccaatagtgagattttttttctgcttctccaagcttatctctactccttccatttattccatggttgtgttaaactgcatcaagtctcccatcacaccttggtatttcccctgcctggaacgtgcctcctagctttatgcacctgtctctcactcttccttcaggacttggctctaacattacctgttacagtctctcctataccttaccatgctatgttaagatgatttccttatggggctggtccctgcactgcattgtgaatcctcctggtcattacccagcacaatggcttgtgtgcagagagtaatcacttgctcagtgtttattggatggaaaagaatattttgatgcactgccttttaaggaatctttcaaaagattattttattctattattcttggccctgcccgtgcggagtatttatgtccttagataactgtgtagaagcagaaaaattaatttattgctgtagttcccaggaggaccccacattatgtaactcctttcatccagaaagctctttagaaactgcacaggagggagattgttgtgccctgcagtgtggatggagaagtaaagaagaaaaatgaaggtgagggaagctgcaccccctaccttaatgccttgccttgggccctcaactgagatttgcaaattctttgcttggcaatgccacataacattccataagaatctgacattagcttgtgcaccgaattatgcaagtcattcctccttcacactccaggaccagaatatagcaattttcttcactgaaattcttataatcctgttttacatgtatctctcatttgagttttagctactgtcatttgagccacctgcaatggctgtcaaatttgtcttttttactaagaaagaaacagaattctggggaggattttcaattattttcattggtgagaccaggcctagacttcagatccagtctagcactctatctattccatgacaatgattcttgtaaaagttgtgcatcagggacatgtaaagagcttggtaagattgcagatgccttggccctattctcagagaagtctagaggggcttagaatatatgtttttggaaaacactcctttggtgatttttacttgcaccctggttaagatgcattgtgttggaatttgttaactcatttattcgttcatttattcattctccaagtattctctgaatacctactatatattcaagtaggcactttgctaagcactggggcactgataatagagggcacagtttcttactaggttcaactcctggaagacaccaaaataaacaaatatttacaatatagtatgaagttccagataatttgatggcttttacaagagcagtgagagcagctgaagaaaaagctgttacccccacctgtgagtgatgcagcttctttggtgtttaatctgggttgccaagaataagagaggcctcaaaggaagactgaagggaagcactgagaactcctttttagtggatattgtgcagtgtggcattaggaacccactcttaggaactcctgggtatttcatttttagaaagcaaaaacaagcttctcatcatttttctaagatatctaatcaagaacatgttgttactgcagagttacctatcattatcagtcatcataaaattgtcaaaacaagaccatgcgaatcttaatattaagaataataggccaggcatggtggctcacacctgttatcccagcactttgggaggcggaggcgggtggatcatgaggtcaggagatcgagaccatcctggctaacacagtgaaacaccgtcgctactaaaaatacaaaaaaaattagccaggcgtggtggcgggcgcctgtagtcccagctactcgggaggctgaggcaggagaatggcgttaacccaggaggcggagcttgcagggagccgagatcgcgccattgcactccagcctgggcgacagagcaagactccgcctcaaaaaaaataaaaaaaaaaaagaataataataaaaattgtatgtataaaatgcatgtttaacaggtcttgtagtaagtgctttatttatttcatttacttctcacaaacccttatgaaataggtgctattactatgcccatattatatattaaggaactgagacttaaagaagttaaacaatttacccattatcctatggttagcaggtggcagagtcaaaattagaacccaactctctctattcagatctcttcttccctatttttctttttacttctctgtgtctaaatgatagtcttatattgctatttcttgatttattagatttctacatactcattaataatttgcttttctagatgagaatttaattttcttacctacttaccccacttccccatcttttcagtaaaattctatcactgcttttggttgaatcatgacaaaaatcgtggtttatatcattaggtatgaaaatattagtcactcacataatttgctgtctgtgcttattttcaatgaatattccttaatgttttaaaaaatttccattatagtgtttattctgttgagactagttttgtcttggagatctccatcccagaatcctctcctttccttatgcaatttttttttgaatgccctgtagagccagcacacggctgtaatcctgggactttgctttgacattcttgtgtgtgggattgcctgcttcctggattccatttatttgtcctgttttgctggaacatagcctcctgctgctgcttaggaaaagatgcatgacatttctgggtacttgatatcttcaaatacatattttctaaccctcacacaattttaactctctagatgggtatagattcctcggtttaaaataatttccccttttaactttaaggcattgcttcattgtaatacagcatttagcattactcttcagaagtctcataccattctcattcttaaagctttgtgcataagctgttttcttttgtctggtagtttttagaatcatctctttacccctggtaatctgaaagtccacaatcctgtgctttatataaacctttgttcatttattgttctgggccctttgtaagctctttcaacttacaaactcatgttctgaaaaatgttatttctttgataattttcttcctattgttttctgtgttctttctttatgaaactcctagtttggtgtaacctgaactaagtctatgagcttatgattttttcacatattttcagcactttagcaatttttgttttattctgtttattagtttgctgcaattttccagtcttttattataatttttaatttcagcaatcatagttttaattttgaataactcaattttatcctgattattctttttcaaaaatcctaagaatgtgatagttgattatatttgtgaagatgctgaattatttttctgaagttttttctgatttttgcattatctatttcattagaattattttttcagtctacttttgttcttctattttatgttgatggtccctttaaaaattttgagagcaagataatcaaaagcagatactgagctctgtgtgtctagaaaggcttgttgaatagtggctatggtgattgttgatttgtgggttttgctttaggttggttttcactggggactacatgtcagttgttgaaggtcttttctctatagaaaaactcttctttcccactaagggtgaagatgtcagagttcttagtagagggaaggagtagcccagctgccatatttgcagactttagttgattattttttccatctccatatcacctacaggggtatgctagttggtgtctcttgagtctcaagtctcctttctttagtttattcagaagataaaccagaatttgacttggggtgtaaatgtctgactgctggtatcctaagaatggagaagggacagggttgatgtccccatttggactttcaaccagtctccctgatttcaactacaattactgtgtaagtgttgagcttcttggattttgagggaattaattagccctactattttccatatctccctctatacactctttagaccatactatctatactctgctaaacctattactacttctctattacttttagatttctaaaaatgtgtgcaaatcttttgaatgctgttgcacatgttctcattctttccagctttctacttttaaaaaagccagtagacaaaggccctgtctcttctgtcagaaccaatgttaactttcttgatcttcaaccctgggcagagtggcttccttgttttcgaaagggttatgttactaagacacgtttgccctctccttctctgttactttacttttttagtattgattttgtctgacctcttttttgtggtcctttgccttctctgatgtgtcttgttggccacatttgaagcgcccttagatttgtggatgacagtcctaccctcccaaggccttctgtttcatctccatctacttcactgctaccgaggtattgatttcttgagaaagcctgctgagactggggggaaaatcaatatcccattaggcaaaagtgaggagcagcagcagctcctctgtagcctgtctgtggacctaacatgctacgggagtgctcaaaggctgggttagcctgtggtgtccagagatatcctaaagtgatggaatagccctagggataatgtagaaaagccaatgacagaatgctcaagatttgtaaatccatttccttgaactaaatgaagtggagtcactttttgagaataattttacttgtcaaagcttgctccggaggaaagaagttctctcttgagaactttcataattcccagtcactttgaattttctagtgtaagtaaaattgttggttagctgtaagacaaattatttagctttcatttcccctggggttctcaaaatgaaagaggaatgacagcattgagatgccaggatactatatgtttctgaaacattatgttgtaaatcccatttttaaataccatcgcaaaaggctcgttatggtagctcttcctggatgagtctctttaaaaaggaagagtttctttggaagactattgtcacattctatttcatctggtaataagtttagattttgtgtttcagatttttgtaaagaaggacagtcacaagcagtaaatgcaaactatcagagttgaaagagatctagcattaccacagtagttgaaacccatatttaacccccaaagtggcatgccattatatatcttctctaccatttgcatggaaacacaagaatattagatgtggcgagcagtttaacttaacctgtggtctaagtactttattttacggttttatctattcatttattcttcaaataatcattgagaacctctatgttacaggtactattttaggcattagggctataccagtggacaaaatagataaaatccctctcaccttggaacttgcattaaagtgagtaaagacaggttataaaatggtaaataaacgtaatatatagtttgtcaggtggagataagtgctaagcagaacatgaaagcaggggagcttgcgtggcatatgtaacatgtgggatatagggaggagtaaaaagagaagtaagcagttttagacagggtgaccggggaaggtttcatcaagagggtgtttttgttgttgttgttgtttttaaggtaaatatttgaaagatgagcactattgagccatataaattcacggaaagaaaatggtcgaggaagtgggtatagcatgagcagaggcactctggcaggaattgacagctgtatttttggaacagcaaggcagccagtgaagatggagcagagtgagcaatagcagagtgatagaggtgaggtcagagaggtgatgtcctgttgagtttttagataattgtaagaattttggatttttgtgagacagaattttctgtgcaagaagccattgggtttgatcagagatgtgatataatttgatctaaaggatcgttgcagtggttttgttgaacctgaattatagtgagaaaggttggaagcagatcagctgggatgctattgcaatatttaagaatgagattgtgagaagtactcaaattctaccttgtatttatgaatgttcttcagacacaggatttcctagcaatttaagtaaaggtaatgacagaaagtgaggatttaaggatgtctcaacagtttttggcctaagcaactgtaagaatagaattggcggccaggtgatgtggctcacgcctgtaatcccagcactttgggaggccgaggtgaggggaatcacttaaggtcaagagtttgcgaccagcctggccaacatggagaaaccccatttctactaaaaacacaaaaaattaaccaggcatggtggcagacaccggtagtccccgctactcaggaggctgagtcaggagaatcgcttgaacccaggaggtggaggttgcagtgagcctagattgcgccactgtacttcagcctaggtgacagagcaagactccatctcaaaaaaataaaataaaataaatagagttggcagtttttgaatggggtcctgagatacagagggatcaatgggtaagagatacaagattcttttttttgtatgttaaagtctaaaaggttactatacatctaagagcagatgtaaagtaagtagttatgtatgattctgcagttcaggagaaaagtccaggctgcagatatgtttggttgttatgtatgtataggtaatatttaaagatccctttggaatgagattaccttgggaatgagtatagatagaaaagagaaaaggactcaggactaatctcttggcattcccacatttagatgaaaaaatgaggccccagagaggggaagtagtagaggtagcataggtgtatttcaaaatagctaagactagaactcagtggactctcctcagtagacagccctaataagattacttttgagtagcctgacttttcactcttttttttctatgctattcttctgagtagtaaactgggaagattttggacaagaaaaaaagtcagattatacatcattggttctctctttaaataatcaaaacttgcattcacttactgtgtttctgctagttggtgggtctaaaaattaaagtaggaaaataaggttattaaataattatccccctctattctgtcaacagtgtattttcttttaagtcactgggaggtctagcatgggtcagaggtgtctagggtgtaacaggagtaagctttgaccagactttatagtagttagagatttttaaatctaacttaaagagcatagtagcaagcctaaatttcaggtctacaaaagggccaaaatattcagaaactttgtaaatgagttcatcatctagattgaaagtcagcttttgttatttgccatgaatgttcaaaatgttaatatataacatttgtttaaaactttcaaattttggaagtttccaacatttattttcttatttggctttcacaaattcccagcacagaatgacttttcactctttgtaagacttgtttattaagaactcctgctgttgttcaagtgaattggctttgggaacccttaccattctggttgtcttacctggacactgtaatctgtccgtatgccagtttaaatggagtggccagatctgtttacaatatactagatgtagactgaacagagcatgggataatgggactctaacctatctttcctagaccacaatatttctattgtatgcagtagttcactacattaatttattttcaacagctgtatcaaactgttagagacatgttgtacttacggtcaactaaaaatcccttatttttctaaataatatgctatcaaatgaaatcttgtgcatttaaactattgataacttgaactcacatgtataattttattattaatatctattaaatattattctgtggtttcaagctataattccaatttcatttttaatctattatttttacccttaaaagtaaaacatctaggctgggcatggtggtgcatgcctgtaatcccagcactttgggaggccaaggcaggtggatcacctgaggtcaggagttgaagaccagtctgaccaatatggagaaaccccatctctactaaaaatacaaaaaattagctgggcatggtggcgcatgcttgtaatcccagctactcgtgaggctgaggcaggagaatcacttgaacctgggatgcagagattgtagtgagccaagatcgtgccattgtactccagcctggccaacaagagtgaaacactgtctcaagaaaaaagaaaagtaaaacatctatttcagttagaattgtgttcgtctatatttgaaagagaccctaaaaatagtgacttaaccaaagaagagctcatttatagcatgaaacaagtcttgaggtatgtacccagggctggaactgcagttcaaggacgtcataaatggctcaacttcctggatcaccagcctcagcacgtgactttctcccttatggttataagatgagggcattagtttctgttttcttttcctgtgtaatgcattgccataaacttgacagcttaaaataacacacatttatgatttcacagtttccatgggtcagtagtcctagcacaggttggttgggtcctttactcagattcttatcatgctaaaaccaagatgctggtcatagctgtgttctcatctaaaccttgggatcctcttctatgctcattcaggttgttggcagaactcagttccttgtggttgtaggactgaggtttctgttttcttgctggctgttgcctgggggttgctgtcagctcctagaggctgatctgagttcttaaccatgtggcctttttatagcatggcagcttacctcttcaaggttagaaagagaatttctctctagtttgctacagtgaagtcttatgaaagggagcctaatcaagggactgactatgctgtcctattcataggtcccacctgcactcaatgggcatgaccctagggggtggacatcttgggaacattagaattagaattctgtctgtcatattagtttctgggcaggattaagtatcctggaaaggttaagagtaaaaggtgtgtaacaactaactctgcctgcccctctttttaagtttagaaatcagatgagatcaagcacattcaaagtggtatggccatagattaaagttcagaaattgatagttttataggaaaccctacttagtagacttctgtttatatttcattagtcataactgcagttagcacaaggaagccagggaaataaagttttagctacctatgcaaaaatcagcattctgttaaaaaggaagaggagatattgcatattgatagccagggtaaaatttgaaatgccaaattagagaaaataaatctgtcttgtttaggaaaaatggaaattaataatggaaaaaaatcacacagaaattcctacacaggattaatcactgctaacattgtcatacttcttaattatatcatattgtgtgcaacttaaaaaatgtactataaggatttctatggtgaactatttgtaaatataatttttaataactgaacaataccatattataaggatgttcataatatcccctatcattaaccctctttttcttacatttttagtttttactattttaaataatgtaatgatgggtatttttgtacataaattattttatatgtttaagattattttattaaggcttactcttagatttactagatcaaagggaatggacatttttatgttcttatcacatattttcaaaaatgatgaactaatttatacttaccaacaatgaactgaagtagtcatcattctgagaacattctaaaattctaatttcatccctcatgtcagtttcgcttctgcctttgggtctaacaaaaatttgataagtatgccttttatgacttcatccaatcttctgataaaaatgaggctacttctggacaggggtttgagtcctatactaccacctgagaaactattcttatttaatgtaattaaataattaatagtcttcaggcacagtttgagcccatacaaatctagccattttactttggaaccaacccatagtcaccttgtcagcagggacattaagaggggcattatactaaagatcagatgttcaaagcagtctcctgattgctcagtctgaaatccttattatggcagaaaatgaagttagtttattgtgtttatatctccattctctgtgtccacagtctgctaaacttgtagtgctagtccgtctcttcagtgataatacttttgctctgaataaattccaaaacagtctttttctgcctttagtattttcttcaagtttgtccttagacttcattttagcttcctgagcccatgtggatgagttcagacaccgctcgaatctgttctgcgttcacttcccttctccttctgtcttttgtacatgttatttttaaacttgattttacctgagatgttcctgtagtcaaactagcttcttttagatgggtttcctttttcttcttccttggattactcatgattgtatagttagaatttctgtttctgagcttcctgtccttattttttttccacactcaattttatggactgtttcccatctgtgagaataacttacacagttttccattcattcttagatatttctattttccagtttgtggaatacttccaaatgtgctgctcccttcctattttctgggcttcaaaggcaaattaaagatattagaacttcctacactatccttggttcaaaatttatggctgtttttttttgttccacacctttgaatatgaatattagaattgcatatgcattttatagagaacttagaaaatgatcacaattataaaatataagattaaaattatttgtaatcaaaccactaattcatttaactgttaacatttttgttctgtttcattcaataagaaatatgtgtgtatctgtatattaaaaataactccatcttattcattttaagccatatttgtccttaaaatgtcagtctatagaattggctcattatcagaactgaagtttgtttgtttgtttgtttgtttgttttgagatggagtctcactttgtcgcccagactggagttgagtggcacgatctcggctcactgcaacctcctccacctcctgggttcaagcaattcttgtgcctcagcctcccgaatagctgagtttacacgcacatgccaccatgcccagctaatttttgtatttttagtagagacagggtttcaccatgttggccaggctgatcttgaattcctgacctcaagtgatccgcccacttcagcctcccaaagtgttgggattataggtgtgagccgccacgcccagccatttcttaaactgtaagaaatttcttttattcctttttattttctctcaaatttattgagcaactactttatacctttctggtgagaggtgcctttcttcaagtcatttatgtttcaactctactttccttatcttgcttttttgcatgtccagtattatagcctcagttttctacttattctgtatatgttaaggtactcaggtgccactagatttgatctgttgggtaatgtgtaagtttacggaaaaatattttctatttatttttaaaattatgcattgcttatgtctatctaaaatgtgaatgcatacatctacattggtatagatatacaactgtccatatagtgatatagtaaatacaactgagggtttccagattcaaaatcattgagccatgccaggtttgagctcctcctcccaaccattcctcttcctctcctgctgcaagttgtcccagtagaagttgccactcctacatactgtgtctctcaagtcactgtaactggccaatagtgtccacatgatccaagtgagtccacttgtggtaccactgtctctgggacttggaattgttctagtcttgagtatgaacatgtgcctgaaactaaagtcatcagagtccttcctcaagatttctctaactgaggttgagggtaggaagccttttctctttagtggcaaaactatgagcatatgaatccagaagctctgaacttctttatttgcaaaaacctgagggcagataggaaaaattaaggtgatctgatggtatttgagagattaattttattttctaaagttcctggagtagcctgagtctttcagcaattctgttactcctgggagctaccctccagatggcctaggtgattcaatgggtttctgatttttgcaaccagtaacttacggctaatcaagttgacagagttcacttgctgtagatgatgattgcttaacaaatgccttatatttaaattctcaatttgagaaatctttcccattaagggagcattattctcagctctcccacaagtttaactacattagacaagagcttgagatagtctcaggagtcaccttcaattctatctggaaaaaagggagagtataaattatctcccttcacagctggtgaaacggatgccagaaagaggacttaatctgctcatagtgaccaagatagtttgtagcaacatcagggctaagactcaagtctcctaattccctgtcctaagctgtcctgagtataaagagattcggtgtaatggatatcagcacagagaagtcacaatttcttttgtgctttttaaatttgaatcagctcatttttctttcccttttacagaacagttcattcataaattacattgtaagcactacatgccaacaggctctatgataactgctgtcaagatagacactccaaatgtgtgtcacttctgctctcaagaagtttgttatctagagagaaggtaaattttaaaaagtaattgtacatgtgtgtgaccatagatactatagggaactgttaggagccacctaggaggttggttagcagccaaccctaccttgctggggttctggattagggagcattggtctatcagagaggataataccttatcataaccattcagatctattgtttccaactttgcattatatcatctactctgttaaaatcatattttagaaaacacatgtatttcattttgggctagtctcaggaaaattagagaaagataaaaatgggggtagcactacttaggtgagggtataaaaaacacacagggtaatataaaattggttaatgaatgtctctttccacaaacccctctactcttaaccactcccacttataccaccactatttccagatcagtagttgtcaaactgtgtgaagaggaacattagctctctgagatacagcattagataagagttctgtagtcaggtaactttatgaccactgcacaatcattcccttctttgagatgggagggagaaagagaaagcctgttctcccatcccaacttgaatctgccttatttccattcacacataattgatacacatctttcccctctgctcccagttcattatggtgctttagttcccctcatgcattccagcccagaatgagaaactgcttttctgtttaatgtaaagaatttgaacacaaggcacactccatgatcttctaaaagactctgagaaatcctatgattaagaaacacttttgtattatttttaatttaacatctaaaatcatttagccataagatggcttttctcccatatcatcctatgaaacttcagaacccacttggaaatatcttactctaatgaagaagtttgtttgcccctccagtctcatatatgacttaacaataatagttgggcagtgttgtattgttttccaagtgctttattttcagtgcctattgcatgccagcactattgctaagttctttcatatatctcctctcactttatacacatcctcaataaccttgtgaagttggcattattttcatcacagattatacgtaaagaaacaggctgagagagaggttatggtgacttcctggaggttacacgagtggcaatacacagagctgggatacttctgagtctttctttttttttttattattatactttaagttttagggtacatgtgcacaatgtgcaggtttgttgcatatgtatacatgtgccatgttggtgtgctgcacccattaactcatcatttacattaggtatatctcctaatgctatcccttccccctccctccaccccacagcaagccccagtgtgtgatgttccccttcctgggtccaagtgttttcactgatcaactccgacctatgagtgagaacatgcagtgtttggtttttttgtccttgtgatagtttgctgagaaggatggtttccagcttcatccacgtccctacaaaggacatgaactcatcattttttatggctgcatagtattccatggtatatatgtgccacattttcttaatccagtctatcattggacatttgggttggttccaagtctttgctattgtgaacaatgctgcaataaacatacgtgtgcatgtgtcttaaaaaaccactttaaagttcatatggaaccaaaaaagagcccgcattgccaagtcaatcctaagccaaaagaacaaagctggaggcatcacgctacctgacttcaaactatgctacaaggctacagtaaccaaaacagcatggtatgagtaccaaaacagagatatagaccaatggaacagaacagagtcctcagaagtaatgccacatatctacaactatctggtctttgacaaacctgacaaaaacaagaaatggggaaaggattccctgtttaataaatggtgctgggaaaactggctagccatatgtagaaagatgaaactggatcccttccttacaccttatacaaaaattaattcaagatggattaaagacttaaatgttagatctaaagccataaaaaccctagaagaaaacctaggcaataccattcaggacataggcatgggcaaggacttcatgtctaaaacaccaaaggcaatggcaacaaaagccaaaattgacaaataggatctaattaaactaaagagcttctgcacagcaaaagaaactaccatcagagtgaacaggcaacgtacagaatgggagacaatttttgcaatctacttatctgacaaaaggctaatatccagaatctacacagaactcaaacaaattcacaagttctgagtctttctatggcaccttttcccttcacattaaataaatagagacaaataataaaaattcaagataccagacaattctgaagctagaggatatactgaacttcatccaaaaattcaaaggagaatgtcaatcagttagatgttagcagctaaatacttccaaaaaagttatgtttgttctggaggggcaggggatctacagatagagatgggaataagactaactcaagcaaagaacacattgagggaagggtttatggtctagttcggttggaatctagtacagatgaaacaggagagttcagttgtagccatattggttgggcaccagttttgtggtctgaacttattctgagtacgcaatgtgagcccacaagatattttttcgatgaagtatgaatgtagttacatcttaattggagtagttaagagacagtctggaaggaatatagaggatgattgcagtgagacagaagaaactagaggcatgtgatcagagagaagactacacaggacatgaactggggtaaaatgttacagtcactatgagaagagagcacgtcatgtccatcatcatctctaagcataagttgaagagccctggactaacaagacagtcacataacttattgcgtagcaaattaaagcatggattgtaaagcctttgatgaatagtgcctggtccatgaaaagtgctcaatgattatttgctgaataataaatcatttcatctagttacatgatatttcaagtattatataagaacttcaaattgatgtatctcctctttttaattttcaattacaagtttgtggaatgaagaaaaataatgttttattccatatctgaaagtagaaaattatataacatattctaagtgctgcctccgggaggttgcgcaggctaagaatgagttgttatctgactgtggaatttaggagttagacgtcaggaatttgtgagggttgggtcgacaggttctatggttgaggccagaattttggtagttagctagtatctctctgatgtccagtgatgatgagcattttttcatgtgtcttttggctgcataaatgtcttcttttgagaagtgtctgttcatatccttcgcccacttattgatggggttgtttgtttttttcttgtaaatttgtttgagttctttgtagattctggatattagccttttgtcagaagagtagattgcaaaaattttctcccattcgtaggttgcctgttcactctgatggtagtttcttttgctgtgcagaagctctttagtttaactagatcccatttgtcaattttggcttttgttgccattgcttttggtgttttggacatgaagtccctgcccatgcctacgtcctgaatggtattgcctagtatcattgacaatccaaatacaaaaagtgactaaaatattaatttatttagctttatcaacacatccatttttacacatggttcttcttcctatttgttttcacccaaggtaacattattctaacaatgctggcagaaatagtttcatttatgctatctggagaagcaagagcttcaaactctctactaaagagttaagggctagggcataagaatcatatataagaaaaaaattaactctctagtttgggagagaaatgaatttgttaagctagaagtgggtcttatccataaaagttcttaagagaggaagatgttgttaaaatcattatatgtactatatagtcgtaaaaatacataatattacttaacttctacatttgccccagtaaaatattcctaattctcataattctgccagatgggtattatctctgccttataggtaaggccaaagaaaattaaatattttgcctaagtacatttagttattaaatgcactgaaatcacctgtggagcaacagaatataaagaatatttttaaaagaacaaaattaggactccaacctatgtctgctttactgcaaagcctacagtagttcagctcaacttttatatactggtttcttcagtcttccttccatttcacctaaaagaatggtatcaaataataactggaaagcaaaataaggacaggcagttggacctgtaaagtaaattttcttgtgaacatgttttcttttttactttctgcagaaatcacccatgtctaaaattattttcagtgaaagctgaactggtcactcttccaaagtccttgttcattcatttattcagtcagtcattcgcttagtctgtatgtcttctgagtgcctactgtttgtaggcactgtgctagacaccaggatggggcaatgaaactcctggaagctcccagtccagtagaggatacacaaacaaagcattacatactgaccagtgggtaagtgccagaatagagggattcctgctcagcctcggggagtcaggggggatttcccatgggaggtgatcactgaagaatgacctgaaggaagaagaaggagacaggagattgtattcattggaggactaattatgtaatgtttaggtatttcatctgtgtatatcgtttaacaagaatctcatgaaatatagtgacgattggcctcatttttaagttaaggagtagaggctcaggcttttcacttgtcctttgtttaacagtaagtggcaaaaccaagttttaaagcttgactccaacatgctttctctttccattttatcctactgtatttgggacaatgatgtaccagtctcagtcctcagtcttggcacatagaggtgccagaataaaagcatttaattatcataaaaataaattgtgaaactcataatttatgtaatttctaccatagatagcactcaataaataacactttgagttgaataagtctagcaaatactgtggcaaagtagtttatcctatatgtgtctcagtctcctcatctgtaagacagagttaatagtttatccacctctcagggtgtagtaagggttaaatgagattatgtatgtaacatacatggcatggtgcctaagtgttcaataataaagtgttcaataattgttagcaattattacaattaatattttgtgtctggttgaccatttatcttttcaagctgattaatgagaaagtagttgaactaaaggctgctgtttttcatgaatggggtttgttaagtctggctaaacataatctttatgcttatctttattctttcttttcaagactgattattgggtatcccagcactgtttcagtaaaagactcacagtgagaacaattaaaaacttactgaattaaaaacaaaatattaatagaggcaatatctatgaatattctggttcttaatggcaattactggtaagtcatacattatatattggatttggaaaatgtatctcgggaatagtaaactgtcaaaaagactcaagagctgtgtctgcctcgtattaaggttatggggtctggtgcaaaaaaggcgaggatgttgaactcagattattttcaggggccaggaacttaacagaaatgcacatttacagacatctacacataaaaataaataaataaattgatcaattaataactctgggctacatgtaacacattgtggactgtttgttcgtaacttttgcgatttagaaagaagcagtagccaaaaacttagaaaacatgggtcctcattccttcaatagacatttatagggagcagtgggttaagagcaggggctctgggccggcgcggcagctcacgcctgtaatcccagcactttgggaggccgaggtgagcagatcccgaggtcaggagatcgagagcatcctggccaacatggtgaaaccccgtctctactaaaaatacaaaaaattagctgggcgtggcggcgggcgcctgtagtcccagctactcaggaggctgagtcaggagaatggtgtgaacctgggaggtggagcttgcagtgagccaagattgtgccactgcactccagcctgggcgacagagcgaggctccgtctcacaaaaaacaaaaaaagagcagcaggggctctgttcttgagtcgggctttgctatttgacatttgtgaaactttcagggattgtattatgagtgtctgaacatgggctgcaaaaccaggtgccaaaagtttgacttgctggctgtgtgactctgggaaagttatttaatttctctatacccctgtttccccacctgattttgtgagtacaaacttagtaccagtaaaatacatgccatcaggcttacaataagttatccataggcatcagctatttttggtaatattactgtttagatacctcatatgcattaggcactgtgcttggatctaggaatacaaatataataaaagataatccttgttttcaaggacacaggcaacaggcagttaggatgtagtggtgtcaatggaggtgggtacgaagtaccagggaacactaaagataacgtttcatggtgctaagagaaggctactcagtagagatatttccagaaacatggaggtatgcaggtagccagagctaagaggtgaggcgcattctataatagcatattccctgtgaggctcagtagcctgtgtgatgctaggcagatcactttctgtctctttgccttaatttcctgatgtgtcaaagaaagcagggcgaattagtgatacctaagttcccctcctctctaatatttggtgattctctgtgagcttggagatgtttcatggctgaaacagagcactagaggtggctagggtgatgggagggagaacttttggtacgtaagcggggagacctaggaggtataaggctctagagctacagaaaggaggtaagaaagatttgaaatacactttgacatctaaagaataaaggacagaggctgaggtaaggccatggtggggatgagggaggcattgtcagagggacacaatcttaggagctccctttgtgaacctttctcttcactatatcccatttctccatgctgacaatgtgactttgtcctatgttaaaataagtgacaatgtggctcagtctgtccttcccaatgactgttacaccaaactctggtaactttcatacaatagggcatcactgagacctggcttctctgcgtcacattcaccatgtacgccttctcttcatggagataccatggtaaagtacaaaactgtgggctttggattcaaatagacgttggcttggacactaagaaaatgtaggccatagactctaagaagagagcaaggagaagagaaagagaaaatataggcagaagccaggttctgacccttactatccctgagaccttgcacacatcatttagtttctctggacttcacttttgtcatctgttaaaggagggcagtagctcccatctcagagttattgtggtgattaagtgaaatgccatattctgagaataatgtctgaaacataaggtcagtttaggggagccccagtagaagctaatgattgcagtggaggaaagcaggtatccaaaggaaatgggaggttgatatgagggacaagggaggacagaagtgcttaacagacaggtgtccactacactagcacccatgttaggtattaatgatgattaatagaaagctagcaaaatctttgccacttatgtgctcaataaacaagtgctaaatcttctcagagaaaggatttttaaacccctgttttgtgtaatactttttgtacagtggtgttattatccagtaggccatctgctctaattaaaatttcacagggctggggaatttagtgccctaaccttggagtctcgggtacagttggtgttttgtttgaggttgatgtatttggaaagattatgggaggatgaattctttgccagcttctaactaggcagatgtgaaaattttctgctaggattttttttttttttttggctctctggtgctgggggtcaaagattaaatactttgccgcaagacagatgttctgaagagctaattaaaaaactgacaagtaaccaggacctctgatggttagttgtatgtgccttcctccaccgaaagatgagaatcactgtggcttagagtgattatattaaattgtatttccagaaagttcacaattggaataaaaaggacagtctctttaaagacattcttaattatatgagtgtgtctcaaaattggctgtacattttaagtgtagaatctttttaaaaaattatgaacaactttatttttaaaattaaatttgtttaaatttcaacttttagatacaggggtacatgtgcaggtttgttatatgggaatattgtgtgaggcagaggttaggagtatgaatcccatcaccatgcctaactgggaatttttttttaatgctcatgctaggtagggccccatgtcagaccaattagatcaatgtctggaaggagggccctggtaacatatttgttttaactttacaagggatatgaatatacagccaggattgagaagttataatttctaaataatatcctaggatctattttattcctaggattcattgtaatgtaatgtatggggagtaggatgggaactggaattgggatagtcttggttgaaatgacagattggctaagataatgttctgctctggataagttacttaagcttttttctagctcccttacctttaaaatatgaccattacctctccaatagatgtttgtgaatattcaatgtgagtattatttaataaacaaagcacctgcttaattaactccatttgtttttagtaaaattctttgttaggaattttagcctgtttctgagacttgctgatcagtaccaatgaaagattctgagcagtggtgcaaagaagaacacgcattaccttaaaacagtagaccatcttgtcatactgcagatatagaaataaatcacagtgatatccagtccaattttacctgtcctggaagtcagagtatatacatttcctttctagcaaaagatgcccctggagatgttgtgactactccctataataaatgcaaatgaaaatttccaggtagtgtttttcacttattctggcaactctgtttctatacaatcacccagaaaatgtgggcttcactgtgtctatttggatgccaactagctcaatcaattatattgcaatctaattgcccaaagggtctgaacctgcaattctatcaggcagggtctgattatccatgctgaccttgggttaatggggagagggaggtttgttctatattgctatttcttctcctagcctaggccctttggccatgacctgattggtatatagaaagtcagaaagaccagatatggttcgaagtgccagtaatacaaatcagccttgcctgattcctggttgcatgctcctaccttgcatgctggaaccaggtgctctgcccattgtgttcctttatttattttgggatatatttgggggggagctgagataaggatttggcttcaagcttgtgctttaaacagtatacgtcttgccttttgtagtaaacatgtggtaaatattagtatttattcttctccctgagctcacagctggccatcccaattactagtgtgtgacttggggccagtcactttccctgtctgaagctcagtatcttcaactgcaaaatgaaggaatggaaggcacacacacattgtgttcttctgatggttaacttgtatgaggagaatatacagataacatttattgaatgtgtactgtatgcctttcactgttctaagtatttcatgtttcaagtattaatatatattaacttacaatcatttgtgaggtaaattttgaattctctcttttacagatgaggaaactgaagcatgaagtggttaaagtaatttttctgaggtcatgcaaccagaaagtaggggaactaagataagggtttgtctccaggcctgtactctaaagactataccccttgcctttttgtagcgtgcctgtggtaaatatagtcaaaagcattttcagttcttcctggctttctcttaaaatttctaatctgaaatatgtataccatgacaatcagcaccttggtacacatgtattaggtattcactaaatagttactgataggtcagctgttaaagtgctaaggatctgtacaggcttgtctagtaatggacttttatagtactgtggttactgacattttacctgaaaaaaaccctcaatggctctacttgacaaatttagtattcaaggctctacagagatctggcaccctgatgccctttccaacctttttatgcttttgctatttacacaaaccctgctagtaggtaagctcagtcaggaatgagatgtatcatctgtatattggtatgcctagtacttagtggaaatctaaatactattaattgggtgaatgaacctgactcagtcaccatgaactgctactctttgtacatgtagtctataagcagtcattccttggctctgcctgtttcctttctctagagcccatccttcatggtccgctctcctaggcctaataccatctagactttacttggtgtgttaaaactcgcaaacaatttaaacagtgttatcttatattttcactaaaatgaccctgctaggttgccactaatttgagcttaggtttcagttctttttctcataatgataatggattttcattgattttcccacacgcattgaattctcctcattagtagattttgtcaatttgcacgttatgatgaaggaaaacctgtttaactggcagttaatatatgagtggaggtttaaaaaatactaacttttatctaatttttatcatatacgaagaaaggccctttctaatgtttaaaattgttttcctgtcatataaacatgtttttattataatatatggaagataaataaactagcattatttaacactaactgggtctaacactgaagaactaacttttatttgtgattgttcctggttttctgaacaatctggaaaaggaatgcagcttagcaaaagccaggctttgatgtcagaaagacccagtgtaagctctggcctcccagcccacttgctgtgtgattctggggaagccttttaaccccttacagataagctttcttgtctgtaaacatatgtagtaatatctcatgtttggtatttggggtataattttgttgcctccttctccaacacacaaacaatagccaaatgggaatcaaagtattggcttattaatggccaggcaagtacgttaaaaccattcaaatagggcttctttaatgagatgtgatggctcttaagtggaagtctgggcgaggagacccctttttaccttcctgaatgggacacagtaggggaccatcggacaggcttccactcagtcacatagcaagtggcagggctccggaacaaagtgttgagctgggtccgttccaaaaagcaaggccctgcctaggtcagttggttgcctgggagcagggagttcaggtgtgacccttagacgtgacactaagaagaggaagagtggcagaagacatgctaagcacaggcaatgactttaaggcacaggaagttgcccaacaggggatggggcagaagcattgctgttctctcaggactggattccatagagtgaggaagatacttgagctgaaggaagaaatgccatccccacccttaccccaacaataataacaaaatccatatggacaaaaaacataatctttatcttaaagggtgttaaatgggattaaataagattacttacttactattgaagtccctagcaagttcacattgtgaaagcaataatgtctgctgcactctgtcaagggaagcaaatttttattaggtaagtgttatcatcaagaccattttatagctggggaaagggaggcttagagaaaggaagactggtctggtaaaaagcaacaacaataatataataagcaaaaaagcaatcacacttttaccttgtgttttggatttagaaaccctgggaaacattttctttaaggctctctagagaggagataaataattaggctatacttgtctggaactccaaagttaccttaagctttcatagctggtgaactcagtttcaggcttgaaggatggagaacctgctaataaacatttacaactaaggtcattagtcatggatgccatttggaagccaacagtacttcttatattttccaagtaatatgactccattcaatgatctcaaaatatatcaacaactttgacatacatgcaaaaatcagggataagtatttccacttcagattggacaacaaggttctgtagtaaaacattttaacaacgagaaagccttgtctctttaagtatgaagaaatacatcaaagaagttctacaaattgtgattaaaaacaatcaaatttaactttattgcagatctttaactactttttacctaatcaaagatatttattttagtacactggtagtatattttctatatgtcttaggtttctgaccagcaggaacaaaaaaagcagtttaacttatactactgacatattttagattcaaatgtttgctccatattttttccaaattcaagtttatttcatttttgaacctaaacttatatttccagttttacttttttccttgaggagttatatccatctggaatgtctagataatgccagggtttatttggggtaataacctcaaatctcagtgggttaaaatagcaaagatcatcattctcatgcacactacatagcatgggctgattgggatacttgcctctacttgattctcactcacagaccttatccaaaagagtttccattgctgtgcttccacagggagaaacagaaaaaacaggaaactgagcactggctcttattgctcctatatgaaagtgacacacattacttctcacattttgacgcccaacaagtcacatgtccatggctaagttcaaagaggtcagaacagtgtactcttccccatttcactagaatatagagacccagaaatatctgtgaaaccattaatgcatactataaaagatgtcttatcattcttattttatatcaaggtcacaaaaatagtatgtggcagagggcaattataaatctaagtcagattaaaggtttatgtttcttctacaatatttttatagtttgagtatgtgaaaatgtgaaaataagaaaattgccctctaactgaaatttaacctactaagtacatttaccagacaccattcctcctatatgacatagcaaaataaatacttcttttttgaggaaccaaacagtaaagttctttgaaggaacaaataagagtgagggaaacaggagggggatgcatatgtagcatataggaaggaatatttaaatgaattgtcacatataagtctctgctctagcattatttcagagtattgaataagaaaagctgttttattttttccctcataggaaaatataaacattgatgaagcctccagatgcctggtgaaacacatacttgcaaatgagtgtgacctaatggagtctattgagccggacgtcgtgaagccccatctcacatcaaccaaggttgccagctgctctggctgtgccaaatcctagtaggcacctttgctggtgtctggtaggaatgacctcattgttccacaaattgtgcctctatttttaccattttgggtaaacgtcaggatagagataccacatgtggcaagccaaagatctatgcctctgttttttcaatgagagagaaatagcaaatgttctttctatgctttcctcaccatcatcacagtgtttacaaacttttgaaaatatttagtctgttacaaacttctgtcatgtagctgaccaaaatcctgcagggccacagtcggcactgttatttgcttcttttaatcagcaaaggcctcaagtcttaaaataaaaggggagaagaacaaactagctgtcaagtcaaggactggctttcaccttgccctggtgtctttttccagatttcaatatattctctgatggcctgacaggcctattaagtagatgtgatattttctcccaagatgacctccattctcggcagacctaagagttgcctctgagttagctctttggaatcgtgaacacaggtgtgctatattgtccttgtcctaactgtcacttgccatggcctgaatgttggcttaactgaatattgtatgaaaagacatgcctccatatgtgcctttctgttagctttctctgactcaagctgtggggctcctctatacatgctatacatgtaatatatattatatatatttttgcaagtgaacaataaaacattaaaagatgctgtttccctatttatgaaagtgctttaagtttcttagtgttgtgaagggatttttttttttttcggacaaagtaaacagggttctcaagatccatttctaaaattttatttcaaggaggagatgagaaatgtatgcttaaagaaactgctggacactattaaaactgggatgagtctatgccatctgcatttactgttcatattgacatttaggctacagagtgtacagtgcatatacatatttttagttaatcagaggaatatgtcctcatagattctgattaagaaaggtgccagatcaatcaacataaaaagaaacaataaaatatgcattgtgacaccttggtttacacagtggttgtggtgctgacacgtgcaggtagctattattttttaatgtcattatttcatattaatatttgtaatacactcacaggagtcgtatatacatatatatatatatatattttgttgttgttgttgttgttgagacggagtcttgctatgtcaccaggctggagtgcagtggcgcgatctcagctcactgcaacttccacctcctgggttcaagcgattctcctgcctcagcctcctgagtagctgggactacaggcatgtgccaccacgcccagctaatttttgtatttttaatagagacgaggtttatcaggatcctgctattttcctgtaagggtcttgactttagtggaggaaacgtggtagctctgtcagcttggcctcttacaactctgcaggatcctgagatagaggatgagatatgtgggtacatatccttaagagtcttgaatccccaaattctttggaaactctgacctagaaaaagaggccttctactctttccagtgggagaacagttaattgctacataaaagccctgcctcagtaggaagttttaaggtgaggcttgcccatatcaagttctgcccccatttctcctcattgcttctagacaaataactagggccaagtctcagcatgatctgagtggaaaaggatgatctgtgttgcaggatgaaatggattatttatcaaatgaactacagaatctggctagtaaatattagtagtaatgtagagaacaatccatgaattggtcttgatatactgaaatattggatcatggcgataaggccggataatagatactctacttatatgaggaaatactttcatgagttaatttttaacattctgacaagtctacctggcattgattctaatatgctattggaatggcttggctccttgaagcttataaatgattctggcctgaaataaatgatgtggacatgccagaactacattggcaaaatactggagaagagatccagggtctcatagaagtgggaatgttagagtgtacttattttgaaaggccggagaatctgccagctcattgtgttctccaggagagcctagaagacaatcactttactaaagcaagaagtgttcccaaaagagggatacctgcatcaatgagaaactcagtagtgattgttctctattgaccaggcttgagattatagagatgttgctctgtttttatgggactggcttccttcatatttaagggtcattaagtggtagactattaaatggtgctggcatatttggttctgtgtcttagacatctaggaccaaaagatggaaataagagtatagcctctccctgttacttttaataatctacttaagaaaatgagtttctccttgccagaacttcaggttttccataattggaggtcttaatacttctaccagaagacatagtaagggttccaataaatctacagcttcagctgctgtctgattaattttggctcctcaggcctataaaccagcagttagagaaggtagttactatacagacaagggtcattcaccataatgatcaaaaggaaatggggttgctactagatagtggagcagaaagtagtgtgtctggaactcatgggattcactggggtgcctcttgatgcctccatcactggtgatatctgaaagggcagttgcagcagcaacatcttgataaggacgagaagtcagggactcatactctcagggataaatgtctgagttattgcactatgcaatgaaccttgattagaagcagtttggtcaagggaagggaaatgatgaatattaattatggcatcacgtatggtgtcaggattaaccataacactggagaatgtagcttatctcaccaaccttcctgttagtattcttactgtctctgtctttttttctttttcatttttagtagagacagggtttcacctcatcaaccatcctggtctcgaacttctggcctcaagtgatccacctgccttggactcccaaagtgctggatttacaggtgcgagccaccagacacctggcctaaacacctttcttttcttttcttttttcttttttttttttttgagatggagtctcactgtattgcccaggctgaagtgcagtggtgcgatagctcactgaaacctccacctcccaggttcaagtgattcttctgtctcagcctcccgagtagctatgactacaggcatgcgccagcacacccggctaatttttgtatttttagtagaggtggggtttcaacaaattggccaggctggtctcgaactcctgacctcataatctgcccacctcggcctcccaacgtgctgggattacagaagtgagccaccacgcctggcctttattattattatttttatactttaggttctgggatacatatgcagaatgtgcaggtttgttatataggtatacatgtgccatggtggtttgctgcacccatcaacccatcatctgcattaggtatttctcctaatgctatcccttccctggccccccaccctctgacaggccccaatgtgtgatgttcccctctctgtgtccatgtgttctcattgttcaactcccacttatgagtgagaacatgcagtgtttggtttggttttctgttcctgtgttagtttgctgagaatgatggtttccagcttcatccatatccccgaaaaggacatgaactatccttttttatggcttcattgtattccgtggtatatatgtgccacattttctttatccagtctatcattgatgggcatttgggttggttccaagtctttgctattgggaatagtgctgcaataaacatacgtgtggatatgtctttatagtagaatgatttataatcttttgggtatatgcccagtaatgggattgctgggtcaaatggtatttctggttctagatctttgaagaatcaccacactgtcgtccacaatggttgaactaatttacactcccaccaacagtgtaaaagtgttcctatttctccacatcctctccagcatccgttgtttcctgaatttttaatgatcaccattctaactggcattagatggtatctcattgtggttttgatttgcatttctctaatgacctgtgatgatgagcttttattcatatgtttgttggtctcataaatgtcttcttttgagaagtgtctgttcatatcctttgcccactttttgttggggttgtttttttcttgtaaatatgtttaagttgtttgtagattctgaatattaaccctttgtcagatggataaattgcaaaaattttctcccattctgtaggttgcctgttcactctgatgatagtttcttttgctgtgcagaagctctttagtttgattagatcccatttgtcaattttggcttttgttgccattgcttttggtgttttagacatgaagtctttgcccatgcctatgtcctgaatggagttgcctaggttttcttctagggtttttatggttttaggtcttacatttaagtcactaatccatcttgagttaatttttgtgtaaggtgtaaggaaggggtccaatttcagttttctgcatgtggctagccagttttcctaacaccatttattaaatagggaatcctttccgcatggcttgtttttgtcagatttgtcaaagagccaggttttagatgtgtaatgtttttcctgaggcctctgttctatatatctgttttggtaccagtaccatgctgttttggtcattgtagccttgtagtatagtttgaggagcaacactaagacacataatcatcagattgaccaaggttgaaattaaggaaaaaatgttaagggcagccagagagaaaggtcaggttacccacagagggaaacccatcagactaacagcgcatctccctgcagaaaccctacaagccagaagagagtaggggccaatactcaacattcttaaagaaaagaattttcaaaccagaatttcatttccagccaaactaagattcataagcaaaggagaaataaaatcctttagagacaaggcaaatgctgagagattttgtcaccaccacgcctgctttacaagagctcctgaagaaagcctaaatatggaaaggaaaagctggtaccagcaaaaacataccaaattgtaaagaccatcgacactatgaagaaactgcatcaactaccaggcaaaataaccagctagcatcataatgacaggatcaaattcacacataacaatatttaccttaaatgtaaatgggctacatgccccaattaaaagtcacaaactggcaaattggataaagagtcaagacccatcagtgtgctgtattcaggagacccatctcatgtgcagagacacacataggctcaaaataaagggatggaggaatatttaccaagcaaatggaaagcaaaaacaaaacaaaaaaacaaacaaaaacaaaaaccgggttgcaatcctagtgtctgataaaacagattttaaaccaacaaatatcaaaaaagacaaagaagggcattacataatggtaaagggatcaatgcaaaagaagagctaactatcctaaatatatatgcatccaatacaggaacacccagatttataaagcaagctcttagagacctacaaagagacttaggctcccacacaataagagtgggagactttaacacccactatcaatattagacagatcaatgagacagaaaattaacaaggatattcaggacttgaactcagctttggaccaagtgaacctaatagacatctagagaactctccaccccaaatcaatagtatatacattcttcttagcaccacgttgcacttattctaaaattgatcatataattggaagtaaaacactcctcagcaaatgcaaaagaatggaaatcttaacaaacaagtctctcagaccacagtgcaatcaaattagaactcaggattgagaaactcactcaaaattgcacaactacatgaaaactgaacaacctgctcctgaataactactgggtaaaaaacgaaattaaggtagaaataaataagttatttgaaaccaatgagaacaaagacacaatagaccagaatctctgggacatggctaaagcagtgtttagagggaaatttatagcactaaatgcccacaggagaaagtgggaaacatctaaaactgacaccctaaaatcacaattaaaagaactagagaagcagcaacaaacaaattcaaaagctagcagaagacaaaaaataactaagatcagagcagaaccgaaggagatagagacacaaaaccccttcaaacgaatgaatccaggaggtattttttttttgaaaagattaacaattttcttaacaacagtgagaggtagtttgtcatgaaataatacatgtaaaacacttagtatagtgctaaaacataacaagtaatcaatacatgtagatattatgatactactatgcttatttttaaaattgaagaagtagtataagcaaagctattaggtaaaaaatggtagatatttttggatgtgtcaaatatgggaccctagggtaaatcaatagaaatgcaaagttgattagcagtcacctaggcttcggagggtttcatggatgacagataaagcctatgggttttctttgggggatgagaaaaatgttctcaaattcattctggttatagttacacaacatgaatatactaaaatccactgaatgctatactttaaatgggcaaaatctgtggtatgcaaataaaaaataaagctgtgataagaaaaaaaagtggaaccacaggaaaaagcagtataaaactattgtttcccttgatgcatcactttagcttaacgatggtgtgtagtcctggtgtttgttattccacgggagggaattttagagtgtgcctctttatcgctgctcttctctgtctagtacttcatcacttctgaattcatgacttgctctcagatgttccaactagcattttgtatgaatttaaacttggctgcatctgagctgtttctgtcttaaaacattggcttcttggaattcccaagcaaccggaaaatttcccaatattggaaaagaaaagatcatgaaaaatcctaataaaaacggtcagaaatgctgataaactaaacaaagtaagtcttgaagacaagggtaaaatgcctttaggaagtgtgtccaaaactgttcactgcattgatgagtctgaaattttccatatcatcaagctaatttattttcttcaatttgactgacttttagaatatcaacctccaggcacaggcagtatatacctaaatgcagtgtactcactgaaactgtaatggtagacataagactctggaatttaaaattccagatgacccaggtcatgctttatattagaacaaaattgtctttcaaagagctcaaagaaactttatgaaagtgtgttttttttgtaaatatcaaatatgagaaagttgctattacttgtaataaaatacaatgttttctattttgtcttgaactgaactttgaagaagttaccttatgccagatgtgtaacataaatttgtattcattggactccttaatcaaatagctatcaattcgctgctctgagcaagttgttgtgtttggtgcattaagtaagtcacttgtcaagatctctagcaaaatgcatagtgcttaatatatgttagtttcttttttttctctctgtgatagctgttgccatggaaaccagaaataaaaaagtcacgggtctctgctctttaagtctacagtttcattgggggaagggagagtgggttaataagaggcaaaagatacagttgaggatcaagaaaagaagactgtttctgtttccactgcatgacattctgcattttattttatcattataataaatgttagaagctataattcattgttcagatcaggtattatatcttttcaaaacataatgtcatttaatcatcattactacctctattgggaggtatgattacacattttatagataagaaaacattgttagaaataaaagatctacatgtatcatgtgattctggcaggatttcttgtcagtgcatctgctcttctggccacaatgggctaatcagagtacttcattcttcgtggctcaagtgacaggtctagaggtgtgcttgtgatccaagctgaactatgcagggtctttggctgtgccttttttccaattctttagaaaaggggcttgtaggaaatggccatgattttctcaccccatgtgacagctgggtgaacacataacctatacatagaatcaagcagttaagaaaaagaaaggcagggagaaatgaagatcccatctgaatctcttagtttaactgtgtataagtcctgatttaacctttaacttcctagttacaagaggcaataaattcctctttggttttgttgttgttcatttgttcagaacagattgcattgatttttctataactcaaacattcctgactaatatagccatagatttgtataggtattggcagctttacttcaagtattctgctagtaaaaagtatataaagacatggccgatggaggaaaagatgctaatccaagtgaaacagtcagcagcccagaaataaaaagataatgacaagtggcttatagaataaaaataaagcacatgaatacttttttggaataaataatgttgttaaattactatagaggaaggtgtaatagaggaaggtgtatattaatttatatacatgtgatgttatttacattataaattaatatgaaaatgctttaatcagagtgtgtttccatacaagaatcaggaggtaaatattattaaaaatctgtaaagtaaggtctggaaatttctagagaagagagaatattgagagtaatcaaagaaggatggaaaataaaaattttgtgaaagtgcaaaataatatggggccatggagtctcccagaagcagcatgagaagggatttgataaatgatttaaatactgattaattttgagaagagtgatattgagctattctctttggcaaaggaaacaaatattgagaggacaaaggataagcaaggttcataaatgctttgtttggccctaaccacaaaaagaattacagtgagtttatggagagacacaatcatttgaatatgacaagtaaatgaaatagtgctcaatcacaggcactgaaaaatcatcatgaattggtatttaaaatactgtttatttagtgcccactttgtgccaactactgtacacatgctgcttagtcacagcaacaccacaagataatcattaacctgatttgagagatgaagaaattataaagctcagagatctttagcaactatttcaaggttcacatagctagaaagtgactgagccagtagtcaaactcaagactggctggctcaaaagattttgttttaccatgactcaaatgacacatttcaatctgcctctatctgaccatattttcatatgaccatagtttagatggcaccaattttcaagattatgtatttattttgtgtaaacatcagttaagtttcagtaagggacagacattatgcagtaaattgaataagggacatttaacgtaagaaaataactagtaaaaggagatcaattaagaaggattggttaaagagaacgctaaagaatccaggaatagcaaatgccgggaaaagccgccacttctatggctgagggagcgcatccaaagagggaaaaaacttggcagatcctccccaacttcccaccccttgcttcaagttgagattcagactttgttggagaaagtgttgccaaagcccaccagataggggaaaagttcagttaggtgcctcatgccagggcagatgatcaggaaaccactctctgggaaatcactgaaactcactgggggttgtggaccgctaggtcttccaccctcactgacgacaccttctggcaagaaagctggctgctggtaaggaaggacacttgtcttctggcagcacaccatagaagccagaaaaaaagcactgactctggtaagagaatcccctccctcctgcaggatctcactagcaccctctactgacaaggctttacattgtgcctactggcaaaggagaaatgtttgcaaggtttccctttggaatttaaaactaaggaaaagagggtggctttggagcagagaagcaatgaattgaaaactggcacagtgtattaattagagtaagccatgataactgcaggaacaactccaaagtttcaatggcttagcataataaaggattccttctcacttaaagcgtgatctggtgctagtcaggtgactctataaagctactgttctataaatagaaactcaactatttagacgccttgtcttgtgtggctccactaccttggagccctttgtttctgtaaacaaacgggagagagacagaatatataagattagaggcatggtttaaagccaatccgataaggtgtatatgtaatttgcccacattgtgctgaccagaacatagtcagaagactctacttttatgagaaactgggaaatgtactagagaaaaatgaaatagacagtaaacatgtagccttatctctgacacactagatttcaaatgcttgtcaataagtttaagttatcatatgtctcagagtcttaattcatctataatataaaaaataagatgtctacttcaaaataacactatggtatttagagcaatattatgtaaagaattaaacaacagagccactacatacttagacattcagtaaatattaaatttcctaaatcagtaattatcaagggtgaaaaaagaaataggatatatgtcaaaatctcaaggttaaattacagcacgcatttacaaagggaagggcatggcagatgggattatatataggaggaaatggaaagggcactctgtggaatgacatatcagaatctagtgtttgtgaaactaatgagggaagggaggagacgggagtaacaatgtaatatttattagaagagagtgggttaagaaagattgagaaactgctgtaaatgcttgttaggtacttgcctgagatgcgtgcaagcctgtatcatcatgcctatttgacttaactcataggctggagaggaagtttcagagcaagggagtttgtctgaaatgacactgcctacattcaaatcctagcattattacttaatattcatgctttcttgagcaatctccttaacatctctgtggcagagactgctggttgccacctaataactttttctccttcttacgtgaatatatactttttagctgggtatttgaactctcagctaaatagtacacttcagtgtcccttgcagatgagtatagccatgtgattaaattgtggtcaatgtgaaatcaacagaaattgtgtgcaattcctgagctttttccttcaatgaaaagaaagtattgcccatattcctttggaatgtcgacatgaagctgagagctagagcagtcatctggaactgcaaagtggaagcctcactgagaatgaaagagtaaaaagatagaagggttcaggtcccagataatggtgagttgccctaccaacagtggactacctgcttgaatattttaggatagaggaaaaaacattatatcctattgaagctatggtattggaggtgtctgatacaacctggcatgtatcctgagtaaaacctaatcctctggttttataatctgcaaaattggtatgttaatagtagagtcatacatcctggttcttgttaagattgacaacaatgataacaatagcaatatcagatgcttatgtagccctcactctgtgcctggcacagtcctaagagctttacttgtgcgtaccatacagatatttgctgtcatcgtttttctactttctccaggatctccaaggtaaccattccaattcctctttcactctttcttcactaaatgccactagaattacaattaatattcagtgtatatttctatatggaaagcagtataaatatgttaatagtatataaatataatagtgtaattataaatagagattatataatttgaataacataattatgtatattattacttttatgtgttggttacttaaaaccagctgttgataatattattatcaactttgtggtcatgaaaatcaaaaacattttttatagtgtgaaacagaaaccgtgtctttataacatatttcctcttacaacaaatataaaatatgcatattaaataaaatacataaaatgaatgcaaaattcatgagtgatacactattcacattaacctgcctttttgtctgcctaaatggaattgtatttaacatgatgtcttgggacctaatttttttctctttgtaatgaacatctttctaattcatcaaatatttttatacagcgtaaattttgaaggtgaatataaatcatattatattaatatatactgtggtttatttaaccaaaccatgaatgctggatatctatgttgttataaataatttgcctttaaatgatgtttcaaagataaatgtttgtttactcaattaattctttgtaatagattcttagaagttaaattgctgaatcaaagattatgaaaaaatgttaagccatgtgaaaattattttcagaaagcttgtattaatttccacttccgtcattgatgtttaaaaatatccaaagagcacagcaatttatgaccatctctcctacacctacttgtaaccattgtggatacccagcagaaggcctttccaggtgtgtgttggggagggagtgataaatacatgaagagaaggaaaacatttgcagacaccaaaaacctgatgtcagattacagcaatgtcattttcaataggagaacagattaaacttatattttagtctcctctttcctccttttattcagtatccttgagaaagatcatcctattccctagcagttggggagaagtactatgacagtaaagataaatggtaaagtaaaaagtaagtaaatgatagggtttcctaagaactattttgtctacttgaaattataacctacaggctcctacaaaacctgcctgtccataatatttctaaaattaatgtcaagtctttgtgtcttgcagttttaaaaatacatttattctaccaaagtgttattacaattttcaacaactaatatgatcaccttagtttgttttaaatccgtggcaataaaatgtactttccaaaatgctattgaggtttacaccttaactttgcataaactataattctaataacagaatgaatatagccatgaaaattttccccagaaatgtttaataatctattttaatcacagcagggagccagattctttgatggattggattagtggaatataaaatatgaaataccaagtacaattggacgatgaattataatattaacatgccatcggaaagactttcttacatgattttcttacagttttacagttccacacaatctcaccactccctcttttctggcacccttcaggaatgctagctaggctcccttaaaacggccattccacaaatgttttcgatttatgttggctgaccttgaatcagaatttatggcatctgtcagtattgtactattctttttcgttggatttgggttaacaggcgggggtgacttttcaactttttaggtgtttttaaaaatctttgttgttttgtctttgtgtgtgtgttttattgctattaaggaaaactatcaaaaatcactcatgattaaacactttttctaagatgagtcaagtgcactagtgagaagggaggagagtaaaacaaggggtttgatctgtaactgactgtgaacaatcagttaagataactcattaccttcagaccagcctaaacactttctgataaaactgggagaatgaagttcttaatcatggaattcctaaacaggttaaatgagataacctatttgaagtatttagaagaatccttgacatcttgaactgtgaaaatattattatattaataaattattattttaatataaattgaaatttaaatatcaccaagcgaaagacatgccttgaccctatgtactaagagtgtgctctgtaacaatcatatatttagatttagaaagatttgacccaacactcttgtcctaggaggatatcaaatatcactggtgttggaggtggcttagctaggacatcttaacatattctcctacacactagactcccatgagtagggctatgtgtttgggtgaggaggtgtgcacatgaccacaagtgcccccatgttgtgctttaattcaactatgcttatatttcggattgatttactccccttaggagattctaattgataacaatggaatgttaatgtgacttaaaaataatttccacttgtatctatttgaagttctctttctctcccctcgttttgattttcggagtgtcacatcaagaaaacctgtgagacttaagaagaggtgatgaattctgtgaaaattaaaaaaacaaaataacataacaaggaaagggatttccttgagctctagggcataaaagtcattaaatatttaatgataagccaggcttgatttaaatcccaagagttcattttcaccattttattgcattttttacatattatacataatcagtttgcataagataaaactgcataaataaattcctcattctatttcaattacgtttgatttttaaggatcaaatatagttctattggtttttaataatttttaaaacaaacagaaatgattaaagagctttattagaaataaaacaaacatataagaacacatttttatttcctttggtccactctatgtccagttaaaaatatacaagatttaggatttaattagcttttataaaaagaatctgcttttcttactaaaaaataatagcaacaaaaagaaaacaaaaaaatatttttcagtatcatgcctggtatgaagacccaaaatgaaaatgggctatttttaaacaatgtagggtttgtttggtttttctgtacctggaggagataccacaagtataagcaacatataggatgccttcgctattatctaataaatcaaggttctaataagaatagcaagttcaagtaagctgtaaagcacacttacagcgtggccttgggtttgtttcactgattgagtctcagaggtgcttctgtaaggctttagtaaaatagaaaatccaacctattttacacattctttcaaaaagttatgttgcattaaaaacagagaatggaaagatcttcaggttattatcccagcactcattgtaggaatgaaactgaagttcaagaatgttcactggtgtttatgaggtcatgcaactagctaagatacagaatattggctaaaagccatatctccactgttccactaatatgtcctgctactgagagaatgttgggtactgggcattctacttacattactttatttagttggcatagcaaacctgcaatatagacttaagttttctcttaacaaataaacacagacttagagaggttgagttacttgcacaaggtcacacagagtaaggatgaattcaaatcctgttctgaccttagcatttgtctttctggtacgctgtcccacctcgttcatagcaggctctctattccatcgtcctttctattgttgaaatatgtgtccctttcctgtttgctgtgtaccaaatttctgacaagaaaccaggaagccaccaccaaataagactctatttatttatttatgtattactgcatctctacctcagctgttctacagtggctcagaagaggctctgaagcaattccgatgtttaaccattccccttgataaatcaaatcacaaggacaggtaatggcttcctagagaggctgactttggaaagaagagaagcatgagcagtaaagtattgataaagtgatactcttgtaaattggtaaatatgtatttgtattcaattctgaaatccatccattttactgataagaaaactaaggttctgcaatagtaatgaattaagacctctgttttccagagacacaatcagaacatattgtcctttttcagaagccctatcctgtccttttctagatttttaggacttctacttgtgtaggaatttcataatacttggaggaggtacaggttgagtatgaaaatgtaaagctaacaggaaattaagggatgaaggaactcgaattctttctgtagtagcgaatgagtttggtcctggtgtcctcaacatgtccctactacagctcctttgtgagtcacaaagctgagggcaccgcatggcacacaatactgtgagggggtcaaagcatccttgaagcatcctggctgtgttttgggagggttccactctctattcttggttactctttcctctgtgtttctgcagaactacgcacaggtattactcacaatcaaagattgttctaggatccaaacgcagactcaggaatttcttcctgacagtttataaactctttggtgcacagatggagtgctttgtttcctctgtacttagctcacaatcaggtagatgctaaatgcttgctggttgtctgattgaatttgcccaagctttgcatctggagttggacttgaaacattccatttgctataaagtaacaggcacttcatggggtattttgggatatcctagaaagccctgggaaataggaatggaaaggaaagtctcttgtctatgtgcaaaacaaggcctgttttaatttagagagtccagtatttgagctgtgtagaaaataaaaacatatggggatatagatctcttttttttcttgtataatttctcttaagaattgtttttctatttaaaaatgttcacaggtagaagtgtccatcagcagatgaatggataaagaaatgtgtttttttattttacaaaataaaacagatatgaaaaaagagtcccccctcgccccttccatgaccacaccactgaaatatttactctgttgacattttgacataagtttctagaatattttctgtttatattttttcttttatttttaaaatttaaaaatatagtgtgaaattatatatgcattcttaccacaaatagaatattttctacatacagaacattttaataaaaacacactggcccctttcttgcttgctttatttccttccatcattcctgcttcctttctttttttctttgtttttgttgttaaagaattatttcttcaaatataactcatttatcaacaacttagcactgttgagattgctgcagataaagcagtgtataaagcaaaggccctgctctcatgtaagtttcactggtctacgtgaccatctacaaatatatatataatatgttaggtgttaatgagttttgcagagaaaggtagacacgtaagagggagagacagtgattgttggggtgctattttatgcaggatagccaaaggaatcttctatgtggagatgacaattgagcagagaaccgggggaattgagtaaccaagctatgaaaatatctgagagaaaaaaacaattatagacagaacaggaaatgtgaaggccctgagggaggaacatgcttggggtttccaaggaactgtaaagaggtcaatgtgacctgaagacactgagctagggagaataaagtgaatgaaataagaaaggtattggggagggtaaagatgatgtaggatttcttattttgatctttaattggaataaaatggggaagcattagaagatactgagaagaggagtggaattatataaccgaaattttaagagggccactgttggatgttgtgtaaagaagagtttacaggggtcagaggtagaagcagaaatgccagataggagactattgcaataatccaagcacacgatgatgctgccttgaaccagggtagcagtggatgaggtgctgaaagtcactgagtgttgactcaaaagcagaaccaaagcgatttcctgatagattggatgtgaggtgtgagaggaattaagggcaatccaaagtttttgtcttgagtaactgcaaaagctgtgaacagagtaggaggtataactgtgatgttagggagatcaagagtcaaatttggggcttgttaaatttgagataccaattggagataggtagttggacatatgatatataatactagagttgagaagaaacatcaggtttagttaaaactttggaattcatcagcttatagacagtatttaaagttatggataatgcagaaagtaaatataaagagaagaaagaattcaaggattgacttctggggtactcaaactttaaattttgaaaaataagaaggaatagcatagaagaatgaaaggagtagccagtcagtaggaggaaaacagagtgacttcctagaagccaaatgagaatgtttcaagaagacaggagcaactacatcaaaggctgctgatagactgagaggatgaggactgagaagatatcagtgggtctatcagtaggtaattactgtaactatgacagaagagtttcagtagagaataagagaatgaagagaggaggtacaaatgtgtaaatataaacaattcccttgcttggaaatgaagcagagaaatgggattatgtcaggaatggtgttgagataaatacagagctttcattttgttctgtatttttgcttatatcttgtgtgttttaggatgggaaatgtgtagcatgtttgcacagtgaaagatataatccaatagactggggaagggaggtgaaaaattaatggtgcaagaaaaaagaaaggtgattattggagtgatgtctttgagtgagaaaagaggatctagggcatgaatggaagaattggccataggcgaaataatgtttctccatagtaactggtgggaaggcagtgtattgcttttgctttctcagtggaataagaagagagtgagaggagaaaagcagatattgaaggttcaagaataaatgaaaaggtgtgaaataatcttctaagaaagtaggaagatgagttgaaatatacataaagaaatatataattgcctgccagcacaaagaacacactcgaagttggcagttacaaatttaaagtgagatcaaaaagtatagttctgccttttgttgccagtcatattctgctatgcaggctcaggttaaagtaggtggaaatttagattcaacttgagttggtgatttaataagaaagtctgatagagggaaagaggggtaagggatatgaggacacatgtaaaagagttcacataatgtttgacaagagagttaagtggattaggaggaaagtggagacatgaggagttgaaggacagtaaagtggtggtaagatcaatctattgtaggcacaggtgggatcaaaggattgtttacagaaagcaaaacttgttcttaataatagtctagggtaggcctcagaaatgagtggcagaggtagttggcagaacaagatcattaaagaagatgaggcttatgatattagaaaattgatgcatgtgcctattgaaactagcaaagaaaacacagatggacttggagagtgatggcaagccatgtaatggaatttttgaataattagggggaaagtagctgtgtatctatctaggaattggagagaatagtggtatattgggaaaagcaccaaatctggcttcattcactgattactactgatgttgtgcgtatgttcatgtatgtattacctattgtactcagtatttactgagtcttccaatgctttggggagtggagctgtcaacatgtgtaaaatgaagattctgcccagggaaagacagaaaacacatcattaaagctgtgtcctctgtgacccactagccatggaagcaatgatgcaggagtggctcattttattcaggagttggagtacccttctcagataagttagcaaggagccctttcgaagataagtatatcttttagaaaaagtgggtaggacatctggcagagacagggagcatgtgaaaatgaagtaagaggtgagggaagagttaattggcaagtgtggcaaggtgcttcatatgtaggtagaatagaatctgtcagtgatgctggggctgaaagatggattgaagccatcataagggtgtgctttttactgtaagtagttggagtcacttttgattttaaacaggagagtgaacatcagatctagattttagaaagccctttctggctgtagtgtggaagatggattgaaagcagcagtggaggtagaataacaagttaggatactgttataaacaatcctggtaagaattggtaaagatttcaatgaacaaaaggactggttatgagagtataaaattggagaagatattaatttttttttcaaactatacaattcgatgtatgttagtatgtttataaaattgtctcacaatcagttttaggttgtttttattacccctgaaataaactctataaccattagtagtcacttccaattgccaccctcccaatgtctggcaagcattaatctacatttttctctatggatttgcctgttctgaacatttcacataaatcaaaatataatgtttattgcagattggatcagaggtaaacattttacccaaagtcattcagtcagtataggctatccaaaagtctgtgaagttgcctagtgtgaaaactctggccatatggacacacggggactcaccaatctgtatgctttctcaataagccaatcagattttctctgaaggagtataataatcttgagaaatatacagagaaagatggttaattagttgtgcttggaacaagggaaacaaaattatgtggtcaaccatcgtgacaatgaagccctagagcaggcatcaccagatatgatcatcttgatacagaatttttccacactttatgaagcctggctgtgggaaagaaagccttgccttcttgtgtgatcttatgtatcttagaatgaactctcatgtctctaggcatcttttcccaaactttattcatttttatactacctctgaagtaggcttctgaatagagtctttcaaatgttaactattttcttttgaagggtgtatcatgattagggtacttatattaatttaccatatctaaagtgaatatatatttatatattagaaaatatatgttttatatatatacactagttaaacccatatacataacatattctttgacatggttcagatattttgcaccctttaaatctcatattgaaatgtgacctcaaatgctggagatgggtctagtgggaggtgtttgggtcatagaaatggatctctcatgaatgacttggtgctgtactcatagtgggaatgagtgagttctcactctatgaattcatatgagatccagttgtttaaaagagcctggcatctatatcctctctctctctctctctctctctctctctctctctctccctccctccctctctctctctctctctgcctccctcttgccatgtgatacaccggccgtctccttcaccttcttccatgattgtaagctccctgagacttaccacaagttgagcacattctggtgctgaggtaagagactagcaggacttgttttttactcacaactctgctgaccaaaacaggatctagtccagacaaaataaagtaaagaaactcagtagaaaccagaatatggcaacaaaagtaatccctacctcccctcattgatcactgccatacgatgttcccaacagcaccatgacagtttacaaatgtcatgacaatgacttggaagctaccactgctttccatggcaatgacccaaaaattattgcctttttcttcacagttctaaataacctacccctcaatttccattgacgtgcctcttcatttgcatgtaattgaaagtgggtttaccaagagcctctacagttgccaagagctcataaattggctctgggcacactacctgtgagttagctgaccataaagagcagtactgttcaataaaagattactgtctaacactaccagctctcacttgaaatttttcccagctaaagccaagaaccctcccaggctagccccaatgctggggcttgcctgtcctgcaacatttggtgactacaaaggaatgaagatagcatatgaaaggccataactgatgtggtagtgagacagcaaaatggtcttgatccgcaaagaggcaagacaatgagagacagtgagaaacagtcagatggcaatcagcggtctgtgggatggcaagacagcaagaggtggtgattggtgagatggcgagatggagagatggcaagaggtggcaattggtgagagatggtgagaaggtgattagtgctaccaagctgtaacattagtcaaagtctctttcaagagccgtcatctgttctggcagagttgaggggaagggcatgtggccatagtaccatcacctcatgtgagatctgtcaatccagccagtaggctatcaggtcactggtccctacattgtagtgaagcccacctgggctgagggaacctagagagaccttcacccaggtcccacacaaagattcattggcatcattttggctcctgtggatgggtgaatgtccctccatcccctgctcccaatattgggtgagctagggaataaagcttctggctaggtggtcagtttaaattcttacatcatttgggtaacctgaagcctgtccttgtcaccccttctcctggtcctttttcttggacttcattttattgctccagcacccattttattttcagttctaaaatgtatgttttgtttgcagttctgtttttcttatttgactttctgttaactgtatttgggcaattgtttaaggcaggacacatgtttgtgaaaggcccttgttatgttgactctgagatgccagagtcatgttgttatatggacctaaccaggcctttggagttcactattggctgcccctcagatgctccagcattttggcatttggtgtggggatcctccttggctgatagttgagcactgtgggttttttggcatttgttatttttggctgccacttgggtgctaccaggtttttggcactgacatttcctccagagctgtgggttctggagaactgtgggcccaccctagggtaatcttagtcttgccttttcttgttttctgccctaaagttattctctgtaacagattttttttctcattgttactttatttacacttttccttctatgctttaataaaaatacttcttttgtcctatttcattcactggcaaacacttataatccacttttgtaatgacttgctacctatacttacaccttctctgtaggaaatgagaatctaaaagggaaaaattgcaaaggcccatttgctgtctctcttgctatacttagaaaaacttctgtgtccagtaaaaatccttgtcagacatggggacaatgactggcataccacaggactcaccattaggatatccatcaggctactgaagcacattcgaatttgactaaagaaaaagaaacttattttctattgcaacactgtttggattcaatacaaattagaaaactaagagatttggcctaaagacgcttctattaattataacgctattttacaattatacttattctgtgaaaaggaagggaaatgagaagaggacccttgtgttcaggcttttatgaccctttactggttcatggtacctctaggaaaccattcctaaggaatcttctcctagctgctccccctagaaggctaacaccctctccagagtctctttatagtcccccacttctgaggtgggtcccacccacaacctaatgaaggattccacctcaagatcatcaggcaccaatcccacttatccaacaagccacagcctataccttctactgaccaagaaagtaagccaaaccagtaccacgaagaatggggtttcatatcaacccttaaaatcaaatctgtgtccattgcgggcggtagctgatgaaaatgaggtaaatcttagagttcatgtgccgttttttatgtgtgatttgactttgtacggggaaaaatatggccagttttcagagaaaccagaaaagttcatagagaggttttttaagttgatcatgttctttaacttttcatgacttgcaagtattgtcaactgcttgctgtgccatggcataaaaaaacaggaaaaagtatgtggcgaagccagtcaattgtagcaaggttagagaaataccttaggaagaagacaagaatcccactcagtttcagggtcatttggttgaggcactcaggaaatatattaatgcagacccagactccctagaagggcactctcttctggaaattattttattactcaatctgcccctgacatgaggaggaagctacaaaaagcagcattgaaacctcaaactcctatgagccagctcttaaatgtagcctataaagtttacactagggacactgcaaagacgtgaaaaacaaagccaaaagaaacagccagaaagtacaattactaatggctgctttaagccccctgccacctcagggttgcccaacaagagagagtgtcacaagatcagcatctgggatgtcaagatgagagcccctgacatgccagcctctgccccttattcaatctgcccctgacatgagaaggaaggtatttatttgttaaattatcagaaatgtttcttgtaatgtcataaatagtttcttttgaaacttcttggatttgtatctcagagatttaactgttgttgtgtcttgctgctttcatctatttttctctataagaaggattatgatgatgtgtctatcctttagctctttttttttgtcagctcctgtgagtttttctcctccaactctattattgtagcctgatgctaaagcattttgtcttagacgtctatgagagacatattttccccgatatatcttgagtctatggttttggtttttcttgatgtgtaaccttatttttggcttttacattttgactctcacattgctttaaataatttaaaggactaatgatacctgcccaccttcattctcatctggcctagaatgtttaattggccaaagggaatgtcaaagacacctaaaaaaaaaactaactctggtcgtgacaggaaaccaggggtcagacacacctcaccatgctcccccttgaaatctaagccagatttaaatgcctttcaaaaaatcatgaaatcaaagtattgcccttacccacaaatgaaaatatagttcccctcttcagttagaagacttagtcttcataaaatctttaaaaaaagatcacctgatgattaattacaaccaaaataaaatggcccttatcaggtattgttaagtacccctactgctgttaaacttcaggacatcactaattgggtacaactgtccagagttaaactgtttcttatgagtccctacagggataaaagaaggacaccacaacctgcatttgaaaaccctagaaaacttaagtttgttgttttacaaatacatagttaaataattgatgctgtgggtggacatagtagcatcaattcttctcttctgcctaattgcaatttacttgtttaacttcctagtaaattttatatcttctagattccacataaagatgatgctagcacaaagcttccaatccatcctgtctgctgacatggaaaatgaaaacatcctactgttggtcccttagatcagatatctagagattcacacacctccaatgctaggcagggcctacacccataaaattgacaagaagctgttacggaagatggaccaccaccctttttcagctcctgtaatattaaggagaaatatcttacctccaagtgggagatgaggtaggagaccataaggacttttttctagtcacaaccctgctgaccaaaacgggatctggtccagacaggataaagtgaagaaaccatcaggaaccagcaaatggtgatgaaagcaatccctaggtactctcattgttcactgacataagacgctcccattagcaccatgacagtttgcaattgctatggtaagagccagaacttactgccccttttctagaaaaaatttcgaaatgacccacctctcaatttgcattgacataccccttaatgtgcatgcaatttaaattgggtttaccaagagccaatacagttgccaagagcccatatgttcctgactctgggcgtattgcctatgaattagccctgcttctcaaggagcagtgccattcaataaaagattgttgtctgacactattggcttgcccttgaattctttcctaggcaaaaccaagaaccctccttggctaagctgcaaagttggggctcatctgttctgcatcagtgccatgcctgtaaagcctgcagaacagtgagtcaaacgaatctgttttatttataaattacccagtctaaggtattcctttacagcaatgcaaatggactaatacattctctatgataaagtatttcaaataaatgaaacaatggccaagtgtggtctcttccctgagtagcccttgttctgggactaagtagcaggtgaggtctctgctcagggatcactgcttggacagatgatctgagatacaaggattaagcattaggtgttctattcaaggcacattctgctcagcaagttgtataatgcctttcagtggcaaaacagaaccaacaaatatccttcctttctttctgcatctcctttacctgttaattcttagttgtattgaaagttgcattacaagactcctccttataggacatttttgccgtcctccaatttgtccccatagcattgtccagcctgctttttaaaatctttagttttctctgtaaagataattgatacagtgtattgaatgtttattattttgtagatactggcactgtgataagcattttacatctgctccagaatagtccgctagaaataagaaagtactctgcataattcaaagagcataggacttaacaccagagacactcctagaggggataatcaaagggccaaaagaaatcctctatctatctatccatttatatttttctgctcacctattacttgacaccaaattcatatgctattcatttactggtgtgttgagggagttcaaacacagaattggtcatttgattgatcaatctaaactctgtgacttgcccaagcttacctcctactctaatatccagctctttgaaaaggttcaatgcccagtaattggaatagcgtatgtcaggtcttatcaatccatcaccagcgtaattaggaaacaattgtcaaactttaacacataagctcttaggcaggagaccaattaccttgtctagggacagaggagaaagtggttatatcaatacccttgtccaaggagaatatgtggttacaacatattcttccacaagaatggggtttatttcttaagaactcatctactactccttggcataacaaaatataacattgtaatttaatatgtttacgcaattttactggcatagaaatcaaaactgtctttcttaaaacaatatgtataatactttatgattcctaactattattatttcttcatcccacaaagcaacagagtcacaataataagatttgggatttctggaatgcctacattgtcacttaatcttcacaatagccttataagatattattattaaactatattttataattgaagaaattgaagcttagagagattaaatcacttactcaaagtcatacagttagtaaactgtggaggtaaagttcaaaccagtctaccaactctgatggtcataatgctacactaagctgcctttctcttctgtagattttgtccctgaatttaccaagaatcctaatttcaggtgtaagaacagcctcaactcttctccttctgtaaagcatggggcagtaattttttgtttgtttgtttgtaaagagttatatagaaaatacttcaggctttgtacgccttatgatgtctgtcttaattaactcaactttgcagttatagtgcaaaggcaaccatggacaacacatcaacaaatgtgtgtctgtgttccaataaaacttggtttacaaagacaagtgatcagggaatttagcctgtgggcttctttttttaaacaagtaatccccatttatttcataaaatcatttgaattgatgtaactattttcttaaaaatataactcatagttagtgaaattttctcaggccatatcataatatttagtctctatataccatttagacaaggtagttacatactataatgaaaatataattaggtttggagccaaaagatctgaatttgatttctgattttatcagttatgagctaaagttactttgtaaaagttacttggcttcccttgtgagcattttccctttttcccttcagtgacacctctgctttttacccaattttgccttgggaaacctacttctatgaacttcttgagcttccttgccttatggctgtcagttggatttgaccagaagggttaacccacaagagatatatagtgaaagaagtgaatgaggttggttctcaccctgcaggatcaccaagtgctgactaattcccttaccagagcatcattgctcctgtaaagacagtcttctttttatctaagtttgtttctccaggttctagtaaccattaatccctaggggtgtgctctaacctttgtggtttctctacacctgtccattccttttaagcagtcctgttactaaactcttatcgaattacccattttgggcatcatctatttctatcaggcccagaataattaatttcttcacaccttaattctgcctttataaaatgggatcaaaatatgcaatctgcctactgtgaagagttgcttattcatctaatactttattcagcaaacattcagtgctattatgttccaggcagtgtattaggtaatggtattacaaagatgaccaagatgtggtctcacccccaagaaacttccaaagaactggaaagacaaacccaaaataactgactattatgtattatgataatgctactatcaaagaaggaaagaagcaacacaagagagagagctgttatatgaggagagaagaaaaagagtcagagaaggatccaaaaagggcataattatgaagtctggctttgaagggtaaacagtcacttattaatcaaaacagaattagtaatgcagagatcttttcgacaaagtgaaattttaccttatctcacttcatcctactccttattttctgatcgatctctgaatccttcaccaggtcattttccttcttttcttgtagtagcagtggctgttcaggatgattttatctccctcttttttttattttgttacacacctcttggagctccattcacttttatatttcatccctttcaaagcagatgacatcaatcctcataactttactttttttttaattctagccccagatttccaatgcaacactatccacacaaaattcttttctcctcgttcaaccacagggtagctttgtctcccaatttccctattactggtaactgtttgaccctatattccaatgtctaggcttcaggacttgcattaagccttattgtcacacacattattactccccccatccaattcattgccgtatacttcctctgcaccttcctcttcgatagtcactattcatttatttattcatttaatattcttattcaatatctattgggtgaacatttattgaatacttactattatccaggcacaattctaggatatggggatatagcagtaaatgagagagaaaaagatccttctgtcttagttcatttgtgatgccataacagaatatcaaaactgggtaattcataaataatagaagttcatttctcacagttttggaggcagggaagttcaaaatctaagcatcggtgtgttcagtgtttggcgagggccctgttctctgcttccaagatagtgcctctttgctcattctgtgaccttttccttgtatggcagaaggcagaagagcaaaaaagcttgagctagttccctctggcccttttagaaggcattagtccattcatgacggcagagccctcatgacttaatcacttctcaaaagaaccatctcttaatgctaccaaaatgaagattaagtttcaacatgaattttgaaagggacacattcaaaccatggcaccaagcttagaatttatattatcatcgggagaaataaacaataaatgttttgccacatttaattgaatatttaattaaatctaaaatgccagtgatttttaaatacataattatttcaagtatcaccataaagcatgctaccagttaaaataagactccatccattgtgagtcattttcatttcagagatgttaaaatgttctataaatataaatttctgtgtctttgaatcaaggaaattcaaaaatatataatgcacatattattatgtatgtaatatatgttatctcagattcggggaaatattaagaaaagtaagttgggaaaaagaataaagagagcttaggatgaggggtgcaattttaaatagggtattcaagaaaggctttattgtaacgataatattttaataaacactgaaggaagtgagggagcgagccttgcatctatctagaagaatagctagaccaacccagagaatagtaattacaaaagctttgaagtaggagcgtatctattcgtgcttaaggaacagtgaagtgaccaatattactaaaggagattaaactagaggaagagtagaaagagatgtcaggagaactagaagaccaaattatctagggtcctttaggctattgtaggaccctagattttatgagaaagaaagccattggaggcttttgcacagaaaagttaaataatctgatttatgtcttaaaaggatgactgtgtttataaatggagggaaaactggagaggataaggaaagaagcagaagatcagttagagagcaattgcaaaaattaggagagtgatgctggaatcttagatctggatgccttcaatgaagttattgagaagtgagactgaataaatgttaaagatggagcttgcaggattttctgatgaatggagatgtgggattgagagataaaggtcaaagatgactcctatgttttggatcagagcaactggaatagtcgtgttgctctttcttgagatgggatagattgcgggagatgcatatttgagagagaagattaggcgtttgttttagctatgttaaatttgaggttcctattagatatctgggtggttttgtctcctgacagtgtttacttcccaatgcctctgccacaggaggcatccaggctgacattttctgctcagactcctaaaattgatctccttcctttttggctttgcatgtcctgaatcatcctacaaatatttttttttctttctaatatattaagatgattaacatttttgctcaaaatttcagtatcttctcattgcttatttaatttagtagactctccttagcttgagcattgattggtctaaactattatgaacattggcaaatatatagatatgtaactaccaaaacaattctattattgatcattttcatcaccccagaaagcttgctcttgtgtcaatttccatctctcatcccaatccctggcaactaccgatctgatttttgtcttagaaattaattttgagcctttttcggatgcaacgtaaatgaaatcatagcatatctaggtttctgtgtctggaatttttcacttagcataaggcctttctgatatatcctttttgttacatgtattagtagttcattctgctctattgccaagtagtaaggtatactgcaactttttttatcccttcaccagttgaaggatattgggcttttccagattttggtttttatgaacaaagctgctacagagggttgaatgtggcgttccaaaaggtatgtccacctggaacttcagaatgtgaccttaattggaaaaagggtctttgcagatataattaaggtaagactcttgaaacaagaccatcttgaattagggcgggttgtgagtcaatgatggatgtccttctatgaaatacagaaggagcaaacacacagcgacacagaggggagaaggctatgtaaagatggatgcagagattcaataatgtgtcacaagccaaggaatgctaactaaggattaccaatagccaccagaagctagcagataggaatagaatggattcttccttagagcttccaggaggagccaaccctgtcagcaccttaacatccataacttctggcatctataactatgagacaaaaaatttctgttgttttaagttgtcaggtttggagtatgtgttatgtcagctgtagaaaactaacacagcttctataaacattaatatacaggtctttgtgtggacatacatttttatttctcttgtgtaaatacttagagtgggattgctgggtagtataacaaagctatgtttcaatttctaagaaacttccaaactttttccatagtgattatactacttttcatttcaaccaacaatatatgactgtttcaattgttttgcacatttgtcatcatttgatattgtaaattttgtgtcttttattttgttttagccattgtagttaatgtgtagtggtgttattttctgtttttctaatgattaattatgagaatctttaaatgagtattttttatatagtgtcttaaaatattttgtccaacttttatttgtttgtttgtttcctattgagttgtaagtatgttggcaggtagggtttaagatggctttgttatctttctttcattattattttattttcttctttcttttctttctcttcctccctccctccctccctccttccttccttccttccttccatgctaaattgctcatcaaaccaccaaatgctgccttgatggaaaaatgattctccattaagttattttattaattaaccacacttgggtatcaggggcgaggtgctaagtttttggacttcgtcttgtgttcacttgatgtaaaaatctatctgtacacaaacatactactgtgatgtttattgcaacttcaaattgagtcttaaaatcagtttacgtgggttttccaactttttttttaattgtttggagtattctggatccttcttttttctatttaaatgttagaatctgtttgtcactttctcaaagaatgtgctacaattttgattcggcttgcatcagatccatagatcagttggagaagaactcataccctaacaatgttgagtagtccaattaatacatacagtatatatatcaccttttatttggatcttttaaacacttttttcatcaatatttttcttcatgtagtagtttagagccttatgaatgttgcatatttattattggatttatctttactttttacatcgttgtaatattttaaaagttaaatttctaattgtgtgtagctagcgaatgaataatttttttgttttgttttgtttttatatattgaccttgtatcctgaaacactgagaagctcactccttacttgtagaagcttttgatagattccttgggattttttctatgtatggaaatgccatcagctgatacagacagttttatttctccatttcctatctatatatctttatttttgtttttttatttattgaactgtctagtatctcatgtaaaatgttaattagaaataatgatagtatatattcctatcttgttctcagtcttagggaaaaagtatttgctttgtttccattaaatataatattaggtaaaggtttttgttagatgcctgccatcagatttaggaataacccattattcctagtgtattaagagtttttatcttaaatgagaattcaattctttcaaatgatttttgtgcatctaccgagattactatattttttttcttttttatgatgtttatgtggtgaattacttagattgatttgcacatgttgaactagctttgcattcctgggataaactccatttgctaatgatgtattacattttttatattactagatttggtttgtacatattttcttaatattattgcatctatttccatgagcaatgtcagtagatagttttcttttcttgtaatagttttgatatcagggaaatgatggtttcataatatcaggtgaccagtattccatcttcttcaaattcttagaagagtttgtgtacaattggtactaaaattttggtgtaatttgctagtaagtttgtttgggctagaagagttccttatgggtagatttttacttaaaattggagttcttaaataatatagaactattgagaatatcattttccttacacgagctatgatactttgtgtgattcaagcaatctgtccatttcatctagctatcatctttttgacatttttaaataataattgcttattattctgataatgtctgttggacttataatgctgtttcctcctttggttcagatattactgttttgtttcttctctcttccagtttaaccagagatttatctattttattgatattttcaaagaagttttggtctcatttgttttctctattgttttttagttgactatttcattgaatttttatcttgattaattcttcccattggcccactttaggtttcgtttgctctatttttttcctactttctaagttttttaattgatacataatagatgtacatattttcagggtacatgtgataatttaacatgttcatataaaatggaaagataaaatcaatgtaactatgaaattcattaccttaaatatttatcttttctttatgctagaagtattttatttatttccttctggctattttaaaatatacaatagatccttgtaaattatagttgccctactgctatatcaaacacgaagtcttatttcttctatcaaatttgtatatttgtactgattgcaatctctcttcataactgtcttccccctacttttccccacctctgatgatcaccagtctactctctatcttaatgggatccactttttaagctcccaaatatgagtgagaacatacagcatctgtctttctgtacttggctttatttcacttaacataatgacctccagttccacccaggttgctgcaaatgataagattttcttctgttttatggcctaataatattccactgtacaccacacacacacacatatatacacacatatatacatatacatgatattttctttatccttttatcccttgatgggcaattaggttgatttcatattttggctattctgaatggtgattcatattgtaaaataagatattgtgataaatatgggagtacagctatatcttcaatagattgaatttctttcttttggatatataaccagtagtggaactgatggatcatatggtaattttatttttagttttctgaggaacctccacacagttttccattagttgctgtactaatttacatccccaccaacgatgtatgagggttcctttttctctacatccttgcaagcatctttatctcatctttttgataaaagccattttaactggagtgaattgtctcattgtggttttgttttacatttttctgattagtgatgttgaggattttttaatatacctgttgactatttgcaggtcttcttttgagtaatgtatattcatatcttttgccaattttaaaaattggatgatgatgatgatgatgaatttgctattgagttgtttgagctcaacaactcaatattctctatattctggttattaactccttggcagatggatagttgcaaatatcttcccccattcagtgggttatcacctctctttgttgatagtttcctgtcaacaatggatacaaagctatgcaaaagctttttcagtttgatgtaatcccatttttctatttttgccttggttgcctatgcttttgagaccttacacaaaatatatttgccaatatctatgtcctgaagtattttcccaatattttcttctggtagtttcataatttttggtctttaatctatttttatttgacttttgtatatagggaacaatacaagtctagtttcattcttctgcatatccagttttcctagcactgttcattgaagattctgtcttttccctattgcatgttcttggctcccttgttgaaatgagttaggtgtaaatgcattgacttatatctgggttctgcattctgttctatttatctaggtgtctgcatttatggcagtaccatgctgatttggttattttagctttgtagtatattctgaaatcaggtagtgtgattcctccagctttgttgttttttttaatcaggattgctttggctatttgggctctttagtaattccatataaattttaggatttttagtatgtttgttcctgtgaagaatgtcattggtaatttgaaaggaccaggattgaatctttaaagtgcatttggtcatattgtcattttaattattaaatatttgttcttctaatccatgaatatgtaataactttccatttttgtgtcctcttcaatttctctcattgtgttttatagttttctttgtatagatcttttgtttcttaggttaaattgattcctagatattttatattctttttcttttcttgcttgctttcttttcttttcttttcttttcttttcttttcttttcttttcttttcttttctttctttctttttttttttttttttttgatggagtctctctctgttgcccaggctggagtgcagtggtacaatcctggctcactgcaacctccgctttccaggttcaagtgattttcctgcctcagcctcctgagtagctgggattataggcttgcacaaccactcccggctaaattttttttttttttttgtattttaagtagagatggggtttcaccatgttggccagtcttgaactactgatctcaggtgatccacccacctcagcctcccaaaatgctgggattgcaggcgtgagccactgcacccagcctatattctttatagctattataaatagaatttatttcttgcttttaaaaatattgtttgctgttggcatgcatgtatgttgattttatatcctgcaatgttacagaattcatttatcagttctatcagttttctgatggagtctttaagtttttctaagtttaagatcatgtcatctgtgaacatagctaatttgacttcttttccaatttggatgccctttatttatttctcttgactagttgctctggccaggactcctagtattacactgaataacaatggtgaaagtaggtatctttgtcttgtttcaggtcttagaggaaatgccattaaattttttccattcggtacaatattagctgtaggtttgttatgtatggtctttattatttgaggtatgtttttttctatgcctgtttgttgtatgaatccaggaatttattcatttcttataggttttctaatttattggtatatagttgtttgtagtagtctttaatgatgctttctatttttgtggtcagattcttctatctcttttctcatttctgattttatttatttgtatcttttctctcttttttagtcagtctggaacaaaacttttcagtttttttgatctttttattttattttattattttcaattttaatattttttctctgatatttactatttcattccttctactgtttttgagtttggtttattcccttctagttccttgaggtacatcattaggttgtttgaagtttttctgcttttttttttttgttttcttttttttgagacaaaatcttgctctatcactcaggctggagtacaacagtgaaatcttggctcacagcaacctccgactcctgcgctcaagccatcctccaacctcagcctcccgagtagctggtattacaggcatgcaccaccatgcctggctaatttttgtattctttgtagagctggggtttaaccatgttgcccaggctagccttgaacccctcagctcaagtgatctgcccagcttgactttccaaagtgttatgataacaggcttgagccactgtgcctggctggaagtttttctatctttttgatataggtgtttattgctataaatgtccctcttagtactacgtttgctatatcccaaagaccttggtacgttgtatttccattttcatttgtttcagaaacttttacattttcttcttaatttcttcattgatcattcaggagcatgttgtttaatttccatgtttttgtatatcttctgaggctcctcttttttattgatttctgattttattccattgttgtcagaaaagatacttgatatgatttctaccttttaaaatttgttgagacttgtgttgtggcctaagatattgtattttgtagaatgttccatgtgcttatgaaaagaatgtgtattttgcaggagtggagtgaaatgttctataaatgtcagttaggtctatttggtctggtgtgtagtttaactccaatgtttcttcgttgatgtcctgtctgaatgagctgtccattgctgagaatggtgttgaagtctccagttattattgtattggtgtctaactttctctttaataataattaatttgtatatttgggtgctccagggtttagtacatagatatttacaattggtatatcctttttctgaattgactcctttatcattatatagtgtcattctttgtctcttcttatagtttatgatttgcagtctattttatttgatataagtctagctattcctgcttatatttgttttctggttgcatggaataccttttccacctctttactttcagtctatatgagtctttataagtgaaatgagtttcttgtaggcagcttataattgagtcttcttaaaaattcattcagctatcctgtgccttttaattggagaattgaatcaatttagattcactggtattattgataagtaaaacttgttactgccatttcgttgtttgttttctcattgtttttaactcttctctcccttccttcctttcttactgtcatcctttgtggtcaagtgattttctctggtagtatgttttaatttgttgctttttatttttaataaatctattataggtatttgcattatggttactatgaggcttacaaaaaggatcttacagttatagcaagttatttaaagagatgacagcttattttagatcaaaaagaaaagaatatcaacaaagaaataattttaaaactctgtaactccatttccccatatttagtctttatgttgtcttcatttacatatttttatattgcctatacttaacaagctgctgtagctattgttgtttctgatacattagtcttttgggtttcacagtagagttatgggtgtatttcacatcacaggtacagtattacagtattctgggtttgtccacttattttaacattgagctttataacttcagaattttatctccttttagcatttccttttaccaatggattttcattatttaagctttggaaacatttctgttacttttttaaaataagctttatatctcttgctcaactctctcttaaacaccagtaattcttagattttttttttttttagggaattttctatatattgtaggcgatcttcatttcttttaagtatgttttttttctcctttgactgtgtattgtcaaatagtctattcaagctcactgatttttctctctgctgtgtccattctgctgtcaagactctctagtgaattttccagttcaacaaatatattcctcagttctaaaatttctgcttgatttttttaaaaattattcaatctcttcaataaattctctgataaactactgaattccttttctgtgttatcttggagatcactgagttgtttttttttttaactactattttgaattttttgtcagaaagctcacatatcactgtcttgttagggtcagtcattggttcctttgtgcatttgagaaaatcacaatttcttgcttgctgttgtttcttgtggatgtatgtctatgtcttttcattgaaggattatttattccagtaatctatgtctggcttgttttgttttttattagatacatttgcttagaggttcttcgtaatttacctgttgattttctctctctttcttttctttttccctgctaggtcactgtcttctttttggtattagatggcaacctaagccaaggtttgcctcagttctagtaaacaatcatagtgcctccagttccaaaagaggggggttccaaaggggataacccagtagtgtgggaagactagctaggagtttgtgcccaggggaactgtggaacaaacttcctgtagcatggttctgttgaacatccacttcgatgtctcctttggctgagttacagagcagagtttccagggctgcagatggatgtccccactttgtctctggccatgttcagggatatatctctctccaggcactttcaacacttcttatggtgtgttgaaaggtatcttgccaaggaacacaagatggtggggaagttgattgtccaccctgacctcactttttgtagtgtataaaccaggagtcaaagggagattttctgtgtttggtgccaagcagattggaggtagtggtatcacagatatacaagcccaattctcttattgttcgctctgagttttttcagttttttatggtcccaggaattgtcttttcctcagacttaagttctgggatgttcctgactataaccttagtgctgtattttgaagagtggggaggcagtgaagccagctagattctacaccagcattttggaaccagaagtcttttttttttctactttttgaaagtagaagcatatgttactgatttaaatatttttttctttggtaatgtaagcgtatactgctataatttttccttttaagccctgctttcactcagtcataaatattcagtttaaaatgtttgtatttttccttgtgatttattttttatccatagtttattcagtggattcttattgtttaaattcatgcaatctgcttggggctctcagagattcttgaaactttggcttgtcttccattaattttggaaattctcagccactaaattttaaatatttattttttctgtgccattttctctctcttctccttctgtcatttcaattgcatgtgcataaaaccattgatagtatctcacagttctgtgatgctttattctcctttcgtttgtttaggtttttttgttcctttattgtagatcatttttctctttgttgtttcagattagaaaactatcaacctatccttaggtgtgctgattgtttcctcggctgtgtccagtctgctgatgaacacagtgaggacctgtttctcttggtattgcatttattatttctagcaaattccacttgactctttctacaagcttcctctttcttcaaaattcccccatagattttttaacatattattttgaagtcactgtctggtatttccagcacatgaatcattgctgatttctgattttggtaagatagactgtttatctcatgacaatgagatttgtttcttgcattttggtgggttctgcaattttttactgaatattggacattgtgtatgtatgaaaggtagacttgtaggtaaattgtacttatgacttacaatgggcatgcctctcctgtgaggctgtaatgtcagaggttgaatgattctagccaggaattgagctgttttgttggtaccattagtctcaatacaccagagctttcaaatcctccagtgtgtgtttagtatggggcctggagtatcagaggcttgtttctggtgttcctgaattcatcctcagctttcatcagttgctgcatttgtgtatcataaagggattctttctccatgcccttgcccctattaccaatcaattgctattgtttattacttgccgcttggcttgtcatggatttgattggtcattatcaagtctccttatccagtgtcagatttaggtaattcttgagcctctgggtgtgggtggggtctttctctgaatttatgccctctttatatggcagtaaaacattgcctttaatttgtggtgtgtcttaggtggcagagggtttcctgatgctcctctactgagagcagaactctgttttgcattggtgcagcatttgaagccccagagaatttcctccttttattccagagttagatagctattgcttctgtcactctcccagaaacagtagatcttgctgggccttgtgcatatgagagttttccattcctccaccgtacatcataggcaggtggattttgtttctgttccttcccagaagtggtatatctctgcttgcacacgtgtgtgtgtgtgtgtgtgtgtgtgtgtgtgtcctcccccagtggattaaaagcttttattttctatgagagaagtgtcctggaaagcaggtaaggtatcctgctcgtcccacagtggcactgatcagaacctgcatgcttgcaccacctagtagtgctgttgctactgtttccctgactctggtctttcttttgagcatctagttgaagctcatgataaagggtttttgagtatatatttgtgaactccttttaagtcttaggctcccagtcattttaaacgttcatattagcccatgcttggcttttaaaaatttaacattttagctgatgttctattaccaaatattatggcagccatttccttctttcattttctataaacagttcatgtgtcctctttctccttgaaggagcttatcgctctttgtaattcagtgtagttcttgctgtcttgcaacctcagttatctgatgggatccaaataagttacattttgtggactgcttgttgttgccttgtagtttgggtgggaacaacattgtctttcagcattcttcatcctttgtgtaagtggaattttttttcactatgcttattttaatattctgatgtctggcaaccagagatattagaatagcattcttgacctaagttctctgagcattttctctttctcacatgtgcatgaaattaaaacgtaggaaacatttcctgccatgttgaaggcatttatgtttttaattcctggggaaattctgaaaatggtttagactcattctgcttcctgatactgtgtctggaactggtgggttcttggtctcactgacttcaagaatgaagccgcggaccctcgcggtgagtgttagagttcttgaaggtggcgtgtccggagtttgttccttctgatgttcaaacgtgttcagagtttcttccttctggtgggttcgtggtctcgctgacttcaggagtgaagctgcagaccttcgcggtgagtattacagctcttaaggcagcccgtctggagttgttcactcctcccgtccagagttgttcattcctcctagtgggtttgtggtctcactggcctcaggagtgaagctgcagaccttcgtggtgagtgttacagctcataaagcagtgtggacccaaagagtgagcagcagcaagatttattgcaaagagcgaaagaacaaagcttccacagtgtggaaggggacccagagcaggttgcctctgctgactcggacagcctgcttttattcccttatctgaccccacccacatcctgctaattggcccattttacagagcactgattggtccgttttgacagggtgctgattggtgcgtttacaatccctgagctagacacagagtgctgattggtgtatttacaatcctctagctagaggtataagttctccaagtccccactagattaactagacacagagcactgatgggtgcgtttacaaaccttgagctagacacagggtgctgattggtgcatttacaaaccttgagctagacacagagtgctgattggtgtgtttacaaaccttgagctagacacagagtgctgattggtgtatttacaatcttttagctagacataaaagttctccaagtccccaccagattagctagatacagagtgctgattggtgcatccatgaaccctgagctagacacagagtgctgattggtgcatatacgatcctccggctagacgtaaaagttctccaaatccccaccccactcaggagcccagctggcttcacctagtggatcccgcaccagggccgtggttggagctgcccgccagtcatgtgccatgtgcctgcactcctcagcccttgggtggtgatgcaattgggcaccactgagcaggggttggtgcccgtcggggaggcttgggccacgtgggagcccagcctggggggccctccggcatggcgggctgcaggtcctgagccctgcccccgtggggaggtggctgaggcccagcaagaattcgagcacagcaggggtgggctggcagtgctgggggacccggcaccccctccgcacctcctggcccgggtgctaagcccctcacttccccagagccagcggtgctggcgggccattccaagtgtgggcccactgagctcgtgcccaccgggagctcgccctggcccgcaatcgcagtgcacagccccggttcctgcctgcatctctccctccacacctccctgcaagcagagggagccagctccagccttggcccgcccagagaggggctcccacactgcagcggccggctgaagggctcctcaagcgtgtccactctggccaccgaggccgaggaggtgctgagagcaagcaagggccgccagcatgttgtcacctctcagtaccatacccaggagagcttgatgtgaacttagcaaattgccttaaaatatttattttcatcaaatgaagatacattggtgctggaatcaaagatcctttcatgttaactggttgaaaaaactttgatttcacaattctcttgcacaaacagcaatagtttatttagaacagcctgactgagaaagttgacttgtcatgttagggcaagtgtgagctcttaataatataaaatgcttatttgtgtcatttaatttttataatagcttcataaagtattgatttttattgtaaaaagtgccatggtatttggttttaatcaaatattagttgaataaaaagaaatgtatagtgtaaatgcaatgacttctcataggggtcagaaatcctaaattttctcaatttcaattctcagcttgcacaattgccaggaaatttactgtgttttaatgagtttatttttaaagatagcataagttcatatttattgttttatttctattacctaagattaggctatgtcttcttatatgaaagaaaaaggaattttgaaagtggttaacaaaaaactcagattatagctgatatattagctaaagtaaatataactcaattaccaacgagatattttacataaatccacacattatttaaaatgtgtatgcaaggagtaggggtccactggtctagtcctgattcacaccatgcatgtttttcaactttagtccttcatcacatcttttaacctcaagtctaaatactgagatttcagtaggtcttttcgaggagtgttttgtagaatttgagtttttgtaaactgaattatgggttaagctaaatgttctttttgttatatatatataaaatatatgtatagatatgtgtatatatatataagtatatatatgtgtatatatataagtatatatatgtatatatatgtgtgtgtgtatatatatgtataattttaccttaagttctgggatacatgtgtagaacgtgcaggtttgttacataggtatacatgtgccacggtggtttgctgtacctatcaacccatcatctagattttaagctccacatacattaggtatttgtcctaatgctttccctccccttgccacccacaccctgtgttgttcccctcactgtgtccatgtgttctcattttttttgatagacagtgggaagtattgccatttgaagttagactaacatgtgaactctgatgctcaacttctctatattgcatattccacaagagtaaaatggggaaaaaataacatcactgataattgaatgaaataatgtgcaaaaagcaccaagcttaatgtctttccattttaagacccaatcaatgttattttcctttcccttatgtgctttttaatatagagctcatgatggtctattagaatggatggagcttcagagttggaaagatacttgaatctcagctttattacttaatggtgctatgtgacattggaaagctacctaacttctctggtctttttttttttttttcatttgctaaatgggtgcagaggggataaaaatatcttagagtattatgaagataaaataacataaacttgttgtgtaatgctaacatctagaaggcattcaatgagctttaaaaaatatcttgctttaacttaaatattctaatcttcctctttaccttcttaatgttttatatgcaactcatttcctgtcagtttgaattttccctcatattcttctctagtggctgcagtgcatctgtcatctgagcctgtaactctgtgcacaaatactaataataaccaaagtcatttttagtacttattaaataccaagaaatattctaaacactttaggcaccttatttcatttgaaaactcggtcttttttaaaaggaaaactaatttataatgaaagacatcactagagtggaaccaacagggattagctggaagagggcctcagggaactttctgaagtaatgaaaatgtgctaaatcatgataggggtttgtaagcatttgaaaaacttatcaaactttatacataaaatatgggtatttcgctgttggtaaactatacctcgatgagaaattgagaggaaaaacctaatgttaaaaatatccttggagtggaatgttttatgtctagtttttagagaggaaaattaaggaccagaatgttcagatgatatattcaagcccacacttactggtggccatgccagtcaaatccagatatattttagtgcatggcccctacacctaaccactaggctccactgcctctaatgagatctgtgcatcctgacccatgttttcatatttatactttgttattttatccttagtaactatatcacatagattgaggcagagcagcatatttacatttatattattgtttatattatctttacattattgaaatattcttatttcattggagatagagttgtgtattttggacaaaactctacgcagaaaacgtatctatcccaaaatgtttagctagggtgatgagacccaggatatattctatccttggaaccactgtgcatttccaagaacactggaaatatttggagatcatgtttcagctgcaataacctcaggcagcatatacaaacagtacctcaataagtcctctggtagcaaaatccttaccaatgtctgccatgcaatgaaccaccaaggagttaggagtatttttaagacaaagttttgacaaccaagtaaacttgttatctaaccttctgttacaaagcatacatttaaatttcaagtcaaatacgtcagcaaagatcccttgaaactttggtgattataaaacaaagcagtctgcagtgcctttgcagagttgggttcactttaaggttatttctgccttaaatgaggcaggagtttctaaacttatcaaagccttgcctgacatgtcctctcccaacttcccatcgaaaagcccgtacaaattcagaaaactgaatctgaaatctaaatttgaaaaggacaattgaccaaatcgaagggagattttcctctgtgccatgatgaacataaactgagaaatgccttcttgtgcaataaactatgagttcaccttctgaaactcaatattaatgtgaagcatttcatatactcatttaatccttacagcaaccctatgaggacttcaatattaatatgtgcatttgtagagtaataaaacatgttagctgggttaattgatttgtccgaggacatacgtcccataattttgagtgggagagccaatattcaggcctctttagctacttctgttccctactatgaaatgctctaactcttcccgaaagaagatattaaaacatgttgatctgctttactgcctatatctaggggatgcactaacctaggtcaactaattttggaattacagctagacattttctctgttgctttcagcacttcttcacctttaaaaaccttttcaaagctcggcatcttggggcattgcaaatggaagcgactatattaaaattggggtttaagggaggaagaatgttaggaatattagatgccaggatgtatggtttctcctgtactgaatgatcaaagaattataaataaaatattagtttctattgaaattacaaagctcgttattgtggcattggttagaagagagtgaatatttgtaaagcaaacctgcacctgagtgtcacacatggagctagaagatgaacaccaagctttcccttcatatttggatctgtgagggaaatgctgcaagcctgttaaatgctggccctgacagaggtctgcccatataaagaccactaaagagacgataaaatgaaaagtcaagaatcatggggctctgaaaaagacatagcataaggccaaagatctttttccagatacagatctctgaaaatgattatttagaagaaccagaagatttttttcacaagattgtaagcaccatgtgaccagaaacactgtttatttcctaaggaattcctagcaagaagaataatatttgacaaacagtaggcattcacaaaacattcattaaatatctaaggaataaaaagtggagaaaaaaggcaaaggaatataattaatgaattccccaaactgtcaatacaaagaaaatttcatgtacataatagctcatattatatgacattgttgtgttattacttggaaagctgtttggagatgtatgcttttatccaaaacataaatctaaggtaattaatgctagttgcttcaacaacctttaaatctcagtggcttaagagaataaggcctatttatcacatgttatactctgacgtggggagagtgttcatttgtgcagctgtctcccatgaggcaactcaaggatccaggctcctttcatctcagagtatcatacttcacttgcgattgtgtgggtgagagagacagaccctatacaagatcacatgggtaacagcaggccagtcttgggaatggcattcatcacttccatccacatgccattaaccagaagccagaaatatggtttcaacttaactagaagaggagttggaaatgttatcttcctgtttgtccagtaagaggaagtggaacttgtgaacatttagctactctctactccattccatctttttgagcatcacatttttattatactctctctcataccttgaacacattcaccatctccataagatgataacccaagctcccatatagtgactcattgcactccacccatctcaaaatttggaatctccattgatgacagtttcctctctgagtccctgttgttgttccttctagttatctggttgtcaatatagacatttacaatggtcgaacacgcccagaataactggaatagaaaatctcatttcaaacgggacactggttcgtagcaaatgtgaaatcccactaagcatatgcttgggaagaccctggtattaatctgttctcatgctgctgataaagacatacttgagactgggtaatttataaaggaaagaggtttaattgactcacagttccacgtggctggggaggcctcacactcatggcagaaggcaaatgagaagcaaaggcacatcttacatgatggcaggcaagagagcatgtgctggggaactctcctttttaaaaccaataaacctcatgggacttattcactaccatgagaacagtatgggtgaaaccgcccccatgattcaattatctccacctggccctgcccttgacacttggggattactacagttcaagatgagatttgggtggggacagagccaaaccatatcgacaccctatcttaggtgtagcgaaaggttcttgcttaagccctggctttactgtctgacaggggctcttttgctcctttgcccactattctccatgtccctactgaaaaagaagtttctcttcatgcatttttctccttggccattctaaagtgagtgtaggaatggtaccttccttgaaggctgtagaaacttcagaaacaactttctatttgtggaaaattggaaacctaaagggtaatttcaaagcttaaacaatgttttgtgtgtggggatgtgcataggggaagtaaaagaggtagtttttgtggcaatacaattacctcaaaaacttagtgatcctgatatattaggttccaaattattctattttcttttaatcataaagttatattatagatatagttgtaaattctgttttattgttttgttttcttgctacccccaccatgactctctcttgatataagtggtgtcacctttaggcagggcatgaatagatctatcccttgagacagtttattcgattgaaacattttacagaatatttttcactcaaagtcttaaaaattactttggagaatttccaacatataaaaaggtagagcgcatagtaaaccaccctaatcccatcatccaggttcaacaattttcagtgcatgaagttaaataaatttaaataaagtttaacagctggggtttgacaaatctctgtgactatatagttcttacattactgtagacaggagaaatagattatgcatggggttgtaaaattgaggcaaatgctacccaaagaaactccaagacttgctgaaggttgcaaaattagtttgtgggaaacctggactagaaactaagtctcttgactcttaatttaattcttcttccatgttgctcttttgtcttcttcagattaattaaagacagtcagaatactttaagcagctactgtgcttatcactttttaggaaaaaacaagtgctacctttcatgaggagcttagagatacttcttaagtgataaaatttacaaaacagaaataattagaaagtggaaaagtagagcattgttaagacagtatttgtattagtccgttctcacactgctataaagaaatacccaagactgggtaatttataaagaaaagaggtttaattgactaacatttctgcatggctggggaggcctcaggaaacttagaatcatggtggaaggggaagcaggcatgtcttacatggtgccaggtgagagagaggagtgtatgtgaaggaggaactgtcaaacacttataaaaaccatcggatctcggtgagaactcgctatcatgagaatagcatgggggaaaccacccccgtgatcgaatcacttcccactatgtccctcccttaacatgtggggattacagggattagaatttaagatgagatttcggtggggacacagagccaaaccatatcagtatttaactgccaaatctatttcttcaaatattcatactttccttttcttcatttattaaactgttttcatttctctactatagctagtaaaaaaaaaagatgatatatgtatctgcaaaatccaaggaagttgcaatttgaaataaaaaattcttgaacagcaaaattgaagacaaaagaaccaaagaccctatttcagggtagactgaatcaagtcttcttgcactcactaaagaaaagacttgcagccatatgaagacaacagcaaagtgaccctgaccattttcttgtagtgacacctccgcatagtgacagatgggctcccagaggagtggattggcaggtcttgccagcacactgtgagttgatcacaagaggaaatcaggcctcacacctgtgctgaaccgagttccaggcacttctctaggtcctgtggaaaaaaaaaagtcatttgaatttctcttcctatagacaataaaggttattaaaaaaaatttctttccattgcctcaatgtttcttatttcctctattataatctatcaccagttagaatcagttgtctatttttgaggcaaatacatattgcaatttgattcttaaatgatcattgaacaaagtgacgtcttcatctatgttacgtaaacagtctaatggctctagacatctgggatgtcttttccaaatttgtttgattaatattctcattttgctcagcactgaaactcatgactaatttgctatttttctctttacttctgaggtttctgccaattgcttgcacttgggtcttttgcagcatctgtgactgttcaccatttgtgatccccttgaacactgttggaaccagacagaaatgatgctcatcctggcctttcctcttcacagctgtatgactcaaagtagaatacattatttctctcagtctcaatttcctcactggcaaaatcagtaagagtctgtcaatatcgcatgattgttgttatatctgtgatgattactgttcacattttcatcatatcattgtagggcacggataatgttgttcagattagcaaagggacagcagttcattaataatttcctcacctaaaaaaacaaattattgtcctcacaggcaatctagacatctttcccccgattccaaagtctttttattaaactccttaaaggtacaatgttttatatatgtttgcatccccacagttcctaacatatcaccttacataattcagcatttttggaactttttggaacagatagcttagataacctgctagatttttccctagcctagcattagttagtagtttttaatggaacaatatttggagaaaattttggctgttacaactgggggtggtgctactggcagctagttggtataagtcagggatactgctaaatatccttaaatatatagggtatacaaacaacaaaaaattatctggccccaaatgtgccaagattgagaaactctagtagagttgaaaatgtagctttggagttagacctaggttccagtcccaactcagttgttcacttgctttatgatcttgggcaagttgcttgacctctctacatctcctggagctccctgacacctatctaccagcgcttcctcctatataaaataaacctctctatataaaataaagctatcacttccttttactttgggaattaagtaaaataataattgtattcagtgcttgatacatagaagttactcaaacacatatacattttccttgcactctttaaagtctgtctgacataaaatgttacaagaatctagacacagagagatagatgcaagcaagaattcttaccttaataagacccagggatgtcaggattttaataagggatctgagtaagacacaggctgttctctggagacacaaagaggagcagttctgatcaaaaatgtgcttacagaaagagaatgaaaataaatttcatgtctcctgttggtggccactctgagttacttttgtctttgcttctcaagcacagaccactttaagaggagctgaacatgccaaggccctaacagacatgtggattccacttgcttcctgagctcagtcagtgttcataaaattgaatgttcataaaaatgaatcacaaagacttacttttatcaagattgttttaaagagtctagagcctccaaaggagactatgagcatccagagaattgggcaccaggacagtgggcaggaaaatgcatctgcacctgctgcaaccagctggccttcctcctggcctgggcccaaggctgacagtgagccggaccagggtcttagaaggctccaatgttgaccatctttgtgttgaagtgctggtacataggtgtcagggagctccaggagagcctgtcctgaggccatgcaaggagggatctcatcttgttcagtgtaacagactcaggaccaaacactgtgcctggaacacagtaggtgtttaataatgattattgaatagtctcacagaaatactgaaacaatagcatttgactctgaaacctgagggaaacactctgggcagaagccaaagtagtttcctcttacaaggagtatgtggcctgtgtggaggtctttgagctgcatgattcatgatcatttagaaacattcctgaagaataataccttctctaaagagggaggcataaaaccttacataaaaggcataactgcagaatnnnnnnnnnnnnnnnnnnnngggaggctgaggcgggagaatggcgtgaacccgggaggcggagcttgcagtgagccgagatcccgccactgcactccagcctgggcgacagagcgagactccgtctcaaaaaaaaaaaaaaaaaaaaaaaaagaaggctccaatgttgaccatctttgtgttgaagtgctggtacataggtgtcagggagctccaggagagcctgtcctgaggccatgcaaggagggatctcatcttgttcagtgtaacagactcaggaccaaacactgtgcctggaacacagtaggtgtttaataatgattattgaatagtctcacagaaatactgaaacaatagcatttgactctgaaacctgagggaaacactctgggcagaagccaaagtagtttcctcttacaaggagtatgtggcctgtgtggaggtctttgagctgcatgattcatgatcatttagaaacattcctgaagaataataccttctctaaagagggaggcataaaaccttacataaaaggcataactgcagaatccagtggatcccatccctcacattagcaagaggtattgaattatacccctattaagaatgaatagagattataagccagagggaagtataatataattcaattgaaagaaatcactacttaggagagttaatgagtttgccattcaaaacgtgtgttaataattagcattttattgaatgcttgccacttcccatccactgaactaagcacttttcacacatgttcttattttatgcccacaacactttatgatatagtttctgttgttatccacattctacagacaagaacgctgaggcttagagaggttaagtgattttcccaaggtcacagaattaatagtagttaaggtcagtatgagtccagatcctgagttcttaaacattaagcaatactcttagggaatcccttggagcatcctcacaaatggaaaaaattgcttggaaaatctctgtctcagctagaggtacttacctgcagtgccaagtcctataaatctgcaggtgagtggccacatatttttggaagcccaaagaaaggaggaaatgtgaatatttaatgtcttgatgtgcaaaagaaaaaggcaaaccagacacattagagaagcacaattatctcttggtattaaaaccagagaatcatttctctggggcctaacagaggataaggtttaatataattaacaatgcctacaagagcatctttactgtaaatatcatgcacaacaaaaaggccaggaccatgaaattactgaaattatttgaataccttgaaattatttcaatacctcttgctaatgtgagggatgggatccacttggttctgcagtcatcccttttatgtaatgtcttaaacctcacttcttagagaaggtattattcttcaggaatgtttctaaatagtcatcaattatgcagatcaaaaacctccacgcaggccacatgtttgttgtaggaagagactaccactaagctctactcttcaggaagtagattctcaaagttgcagatgctccctctatacatgttgaactggctctgagaaaacaatgtttaaggaggactgtctgaagattatactgttcgtttgttcctctaggtattataaaatctatctctacattgcaaataaccagcaggaatgtccctagatttcatggttatggtctttttgttgtgggtcatatgtattgtaaagatgctcttggaggtattgttaattaaattaaagtatcctctgtgtgaggccccagagaaatgattctctggttttaataccaaagataattatgcttccctaatgcctctggtttatcttttccttttgcacatcaggtcatgtaaatattcacatttccttcttgttttggctgtcaaaaatacatggccactcacctgcagatttataggaacttgcgctgcgggtaagtacctctagctgatgcagggattttccaagcaattttttttcatttgtgaggatgctccaaggaattccctaaccccctgttatttttacctcctgttaatggggaaagtcagggtaattttgcagggggtagagatgaagaagaacagataaaagattctaagcaatgaactagggctggggctgcacaggtacagataacaaattccccaccctcaaagagtttgtagcttaatggaggaaacacacaggctaaaaacttttgtaacacagtttttaaaaattgtattcatgtgaagatgagaacactagacaagacctccgagctccctactctgccgagggaaattaagaatgctttaatacaggagttaacatttggacaggaccttgcagcataaggaaacaacatttattgaacactacatgctgtgtgcttctttatttcgattagctaattgaatcacggcaacttcacaagataggtgcattttccctcattttttttttttgatagactaatgaaagtaaggcccaggaaaatcaagcatttattcaggatggcacaggtatggagcttcagggctgggatttcaacctagatctgcttgtcttcaaccatgctcttgccttcatgtattaggactattcaggtctaatgaggccttcaaatgaggatgcatggttctgggaattgggagggcaaattccacccacgaatatctggttgaatgcctgtgtcctttgtgcaggcagaggaaagagcaaaatgatttctcaggatgtttttagctcactttctgtgcatgcttgtctcagggaagaaaacgtctccacttctaacttttgatcagtgttcctcttagtgtaagtgtctctccagtggtacagtgaagtttttagatcagctgcatttaaactggatgaaggaagggatcaggtcagtcttgtttaggactcatacctagtacctggccatagaagccattgatactcattatatattcaccgagtgaacacaggaatcactgaagaaactgggagataagcattaatatattaggtttggtgatttggtagtttctatatcccctaagtcctcatgacaattttatgtatgtatgtgtgtatttatttatttatttatttatttattgagacggagtctcgctctgttgtctaggctggagtgcagtggtgcgatcttggctcactgcaagctccgccttccatgttcacgccattctcctgcctcagccttccgagtagctgggactacaggcgcccaccacctcgctcgtctaattttttgtgtatttagtagagacgcggtttcaccgtattagccaggatggtctcaaactcctgacctcgtgatctgcccgcctcagcctcccaaagtgctgggattacaggtgtgagccactgcgccgggcccctcatgacaatttaagtcctcaataaacgttttgaatgaaaaaactccccaccatttagaactgcatttagttcccgaagacttccctgacaatcctcattttgacctactcctactccacaccacacaagaaataccagcacatgatttctataacactctacatctcctgccagagcagctattaacattcctggtattgtcttctcagttagacatcttcttccattcccatataggcatcctgaagacaaacagtgtggctcccttagtctcctttgtatctgtaatatccagcctggcataaagtaggcttgattggttaatagaatgaaagaacaaataaatcaatgaatacaataatttgctgttcttcattaccatactaatcagatgatgaacaagcttttacagggagtcataatccagaggagagctaaaaataattacacaaaagcaaaattattatgtataaactgcccccaccacacacacacacacacgaaagaaaaaaatacatgcattctaaaatggcacctaagtagcagtatgagggccctcaaaagcaaagcaaaacaaagctcaactaaactaaactaaacaagttgtattcatcattagatcaccagggcctccttttaattgtctcattgcagtagttctttctttcaaagtttccggtgcctcctactctgagttgctgcagtttaagtgttaaatttctcatgctgaagatttgctgccttgttcatctttcgttttccttcattcttcctgggtagctgcatggtttttacttcttattccacacaatcctttggccaagttttcccagcttgaaaactgctttatattttcatgttttttaaatagtccatgtattcaagcaccatactctttgttgacttgttttagtttttctatcacagtacctctttcatgataaagcttttcctctacactttgcagatagaatgtaataatatgtgattgattttctcttcctagtcactaaacattttgaaagtgattcaaaagtccccagatctcttcatacctatctcaactctaagaacattttagtggcagccatgcattacatactcatattattcatgttactgtgtatctgttgctttatgaatattgctatttaaggttaatctaatgttgatgatttacaaattataatatcaaaagaaatatctgtaataataattgacatctgtatgttttacagtttaaatactatttatttaattatctttttaaagagatgggcatctcactatgttgcctgtgctggtgtgcagtagctgttcacaggcatgatgatagtgcactagagccttgaactcctgggctcaagccagcctcttacttcagcctcttgaatagctggtactgcagtcacatgccaccgtatcatgctaacaggtatcttaatatcagtaaattctcaatagccagtgttaagtggttacttacagatgaggaaactaatgttctgggtggtttgcccaagatcaaatagtctacctagattttttttgtctacatattattccctacattatatccacttgtgtgaaatttagaaccagacaactctgactctagggaaatgaattctcatgcccaaggctttgtcttaggaccatggtagacttaaggagatctcctgataacgctgtgcaattactgggttctgtatctttgtgcaagctgtcctttcttgggaaacctgttcccacctcaaatgtgaaaaccgtatatatctttgtgctcagatgttactttccctgtgaagcacatctatcaccctgaacaaagttagtggcctccttaatgtcccttgtatatctttccattactggatttatcacactggaatatctagtgagatttctgactccttggatttggtttaggcagttggaagacagagattatgtcacatccagtagaagcttactaaatcccagatgagctgaatcagctatacagttctcagcattaaaaccatgttgggcgcattcccaggttaatatttgcttccctttgggttttttgctaaaattcaaactaatactccaagttacttaattgcttcactgaggtgtgtcaaagttaattgaagtattacatgttttatttttccatcttatacataaaacttgaggctgttagaatgcagaaaactacccagaaatgttgtcaagtcaaggagacctggttcatcctagcctggttcttcaagcctcaaaaaaacaagatgaagatggaaggccagttagagggactgttactctacatgcaagaaaaatgttatctgtcattcagacttgagtttctatctcttattcttcataatagctaagttcttagagatgtggctgggtgtgtgctttatatgcattaatccttacaacagtcaggtgatgcgggcataacatcttcattcttcgcagttcgtgaacatgagatcaaggcaggtttaatgacttggcaagttcacatacaagttaaaaggaaaatgtgagatgtgcaaaaaattctatctggtttcaaaatttgtactctttacactacatgctgcatgatcttttcttgctgtatgagcagcaatgacataagtaagaatgcctttctcatcttattcattcaaacattttcttttccacctggccagtgactttgctatgaggaaaaaataaaaaaaaaaaaaaagcttaagtcctttctcctaacagtgcacctggttaagaactaaagtagctatttgtccttggcaagtcactgcgtatcaaggcttttgataaaattcatttaaattttctgctttttgtctcatggccccaacctcctgattttatttggttttaacttttatttcccagtatgagagaagctcctattggtttttataaatgcatctttctcactggacgcacagctgtctgatgactttcatgttcatctgataattttccaggacatgaacagaaggcatggaatatatatatatattccatatatatgtgtgtgtatatatatattccatatatatgtgtgtatatatatatattccatatatatgtgtgtgtatatatataccatatatatgtgtgtgtatatatatattccatatatatgtgtgtatatatatattccatatatatgtgtgtgtatatatatattccatatatatgtgtgtatatatatattccatatatatgtgtgtatatatatattccatatatatgtgtgtatatatatattccatatatattgtatatataatatatatattccatatatatgtgtatatatataatatatattccatatatatgtgtatatataatatatatattccatatatatgtgtatatatataatatatatattccatatatgtatatattatatatattcacatatatatgtgtatatatattatatatacacacacaacatatatataacatatatatcatatatatcatatatataatttatatatatgatatatatatatatatatgaaatatatatatatatatatatatatatatgaaattttttccttctgccctgggaggcagtaatgagaggtataaaaatttgtattaacctccaccccactttttattttggtcagccaaatgcccagcaagtaaagagaccccacaaactgaaagattccttgctgtcaaaggtggcctcaatttcttctaggtcactgaagattttcatctattagaaaacagctttgagggaaactgccaggagcatagtcattaatgtagcattgatagttcaatgtcaggaacttttgagaatggaggaaattatgagatacttttttcttcacattttaaaaaagagagtatctatttgataaaattcaaatacagacctaaggaagcatatgaacaagacctaagtaagcttttgagtgaaaaagacctagggttgaaatccagttctattgttacctttttgtagtggtttttatatgattcaatgcatacattaaatttcatagggccgtataccaaaaaatttggaaggttttcaggcattattaattcaactatattttcagcaccaaactcttcctcttcactttttgggacggacagcataaatattagacatcttgcttttgacctatagatctctgagactgttacatattttaatctcttttttttctgttattcaggctggagaagttctactgatctatctaaaagttttctgactctttcttctattctctattcatctctatttcactgtcaaccccaacaggtgagttgtttattcttttattatttatttattttgaggcggagtttcgctcttgctgcccaggctggggtgcaatggtgcaatcttagctcactgcaacctccacctccctggttcaagcaattctcctgctttagcctcccaagtagctgggattacaggcatgagtcaccatgcccagctaattttttgtatttagtagagaaggtgtttcgccatgtgggtcaggctggtctcaaactcctgacctcaggtgatctaccagcctcggcctccgaaagtgctaggattacaggcatgagccactgcgcccagccctttatttagttattatattttttagctctaaactgtcatttagttattcctatggttctaatactttgctgaaactttctattttttgtttcaaaaggtttcaaaattccatattgggacaattttataatgcctgctttatagactttgtcagataatttcaacatctgtgctatctcagtcttggcatctgttgattgctttttcccatgtaagttgagattctccttgtttttcacatgatgactaatttttgactgtatcctgtttaaacagcatacaaaatgttgacttttttttttttgttaggttccggctgcaagttcagtttcaccttctgtgggggttgtctattgttccaatgtcagttgagttttcaaagcctttgcttctatccgtcctgcttgtgctccacctagtatggtggacctaggtggtgatgtatgtcaccactcagttgtcaaggatttggaggtgctgattagaatcagatctatgcatgtactgcctagcatttcatgtacaatttgcatgggctcacatttctcagctactttttatccttaatctctttgtcagtttccagttccctggggatcactttttaggccctccagcaggaaagatggggctttagttatcctactccattgcagggccaagaccagggtgaaaaaagtgaggcacatttcttgggtacagaaattaagagggtaccaaaacattcaatagataagtaaaattttaatgcgatattttaaaaaatcaaaattaatgtgaaaatttataacgaacaaaatgttgcaatttaagtaaagacaggatccagctctgcactttactacccagcctcacttcctcaacctaattccagccctcctttgctgtatatttctacaactgcacctccatctggagccaggcagcaggaagacaggcagaaaaaaaatgtaaccagtttggtggaactttgaattctggtcttcttcctcaaccttcctgttactaattatatttcagagccttcaactagttgatctatgcattctatccaggttttgcagctatactctgtgagaaaaacagagtagagggtggttatttcatcttaactggaacaagaatcagagaagaatattcttagattgctacaaggagctagatgaaagactgacaaaaaagtaaattctaggggaaaaagcaatacatatttcaaaaagcaattctgtcaccttattctttctagtaaaactttttatccttaaaaataaaattagctttctaggaattatacaatacactcttttcctttccttcaccttccagtggaaagtgcatgtgtacgtaggtgcatgagtgcatgagtaggcatacgtacaatcatgccccagagaaagacagaaacagaaatagaaacaaagtgggagggacttagataaggatcttgtagctttaggttgagtttctccagtgttccttttaccattagggaaagattaaaatgttagaataaataacttataaggtcctatatggatttcctcttccttcctattttgaggaaatcatcagagggacaaacctctctcatgggtacagtatttgctaccattgacaatgtcacagttttttctatttataaaaagaaggatacttacataaagggtaattcattgttataagcaaggtaggtcaagttcggtgctggcattcctttagctgtctgcatcagtaccttaaacatatgaaaaacatattcacatgtactatttgaagaatgtagctcaggatttttgcttatttgctgctggacccagaactgttttgttcattgaacaaagtgttagatggaaggttgtaaaacgcagggcagaatgtatttaaatattatttgaatttgactgtagaaagagaactgtgtgaaaaagctgttgactgctttttacctttgtggtctctggacctttgaattcacggtagtaaaaaccaaattttaacctacatttggcccagacggtgaatttttctataaatatggaaaactctaaaatatccctttcacttgcatccatgtgaagagaccaccaaacaggctttatgtgagcaacaaggtcgtaggtggatctttctcacggagcaaagagcaggaggagaggggattgatctcccaagggaggtcccctcgatccaagtcacagcaccaaatttcacgcgcgtccatgtgaagagaccaccaaacaggctttgtgtgagcaacaaggctgtttatttcacctgggtgcaggcgggctgagtccgaaaagagagtcagtgaagggagacaggggtggggccgttttataagatttgggtaggtaaaggaaaattacagtcaaatcgggggggttattctctggctggcaggggtgggggtcacaaggtgctcagtgggggagcttttgagccaggatgagccaggaaaaggaatttcacaaggtaatgtcatcagtttaggcaggaacaggccattttcacttcttttgtggtggaatgtcatcagttaaggcaggaactggccatctggatgtttatgtgcaggtcacaggggatgtgatggcttagctttggctcagacacctgacattcctgtcttctattaataagaaaaataaaatagcgaagtgttggggcggtgaaaatttttttggggtggtatggagagataatgggcgatgtttctcagggctgcttcaagcgggattaggggcggcgtgggaacctagagtgggagagattaagctgaaggaagattttgtggtaaggggtgatattgtggggttgttagaagaaatatttgtcgtatagaattattggtgatggcctggatgcggttttgtatgaattgaaaaactaaacggaataagacaaggagaaaaacaggtattaaaggactaagaattgggaggacctaggacatctaaccagagtgcctaaggaggttcagcatagccctgccagcaaagattatttactttaagagggactttagagtggcggtttggggataggaccaggagatgtcagctgtgaaggcttggagaaacagtgtaaatgggcagtgtaaacaagagcagggcatttatgagtagttgagagcagtgaatagaagtatgactagacagaagacagtagggatgacaagttttttggggcacagtccaagttggtctggtgtctggaatgaggttggggcctaataaaaaggagggtctatacaggagcttaaatgggctgtactttgtagcattccgaggacaggcctgaattatgagaagggaaagaggtaaaagtactgtccagtcctttttaagttggaggctgggcttggtgaggtgtgtctttaaaagaccattagtctgttctgcctttcctgaagattgaggatggtaaggggtaggaagtttccactgaataccaagagcctgagaaactgcttgggtgatttgactagtaaaggccagtctgttataggactgtatagaagtgagaaggccaaaccgaggaattatgtcagacagaagggcagaaatgaccgtggtggccttttcagaccctgtgggaaaggcctctacctatccagtgaaagtgtctacccagaccaagaggtattttagtttcctgactcagggtatgttgcataaagtcaatttgccagtcctgggtgggggcaaatcccagagcttgatgtgtagggaagggagggggcctgaataatccctgaggagtagtagaattgcagatggagcactgagaagtgatttccttgaggacagattttcatgatggaaaggaaatgagagattctaagagacggactagtggcttgtaacctacatggaagaggttatgaaatgacgacagaatagaatgggcctgtgaggctggaaggagatattttccttggtctaagaaccatttgccttgtgtgggaagagattgataggtggaagtttcagtgggggagtatgtgggagtggccagatgagaaggaaaaaaactgaaagtgagggatataagttggaacactagctgcttttttagctatcttaccggcataagcattgtcctgagcaatgggatctggtgccttttgatgtcctttgcagtgaatgactctagcttcctttggaagtaaagcggctttgagaagcgtttttattaaagaggcattaatgatagaggacccttctgtagtgaggaaacctcttgcatggtggtgcaggatatggaaagcatatttagagtcagtataaatattgatgtgtagtccttttgcaagagtgagggcttgacttaaggcaatgagttcagcttgctgagaggtagtggagtggggcagagtggtagcttcaatgatagatgtggaagatactatagcatagcctgcctttgctggtgagtggcgattaggcctggtggaactgccatcaataaaccaagtgtgttcagggtgaggaacatgaaagaatatggggatatggagggaatgtcaggtggatcagagagatacagtcatgggagtcaggtgtggtatcaggaataatgtgggaggccggattgaagtccaggccaggaacaatggtaattgtgggagactcaacaaagagtgagtacagctgaaggagccgggggagcagaaagtatatgtgtcaggtgtgaggaagaaaatagattttggaagttacgagaactgtagagagtaagttgagcacagtttgtgattttaagggcctctaaaagtattagggcggcagcggctgcacgcagaattgagggctaggcaaaagagtaaggtcaagttttgcctaggataaaaaggctacagggcatggtcccagtccttgtgtaagaattctgcctgcacagccctgcacttcagctgtgggtaatgaagtgttgggataagtcagggagagctagggtgagggcagtctctaaagctgttttcaagcaacagaaagaggagtggggaaaggatttaggatctatggggtcagctaggtttccttttgtgagtttatgtaatggttttattacgaaggcaaaaccaggtatctaaagttgaaagtatccaaccatgcctaggaaggaaaggagttgtgttttgtagaaggtgttggggtttgagagatcagtcagacacgatctgcagggagagcacatgtgtttttatgagaattatgccgagataggtaacagatgaggaagaaatttgggcttgactgaagtgatgggagctgtctgtgtagccttgcagcagtacagcctaggtaatttgctaagcctgatgggtgtcagggtcagtacaagtgaaagcaaagagaggctgggatgaagggtgcaaaagaatagtaaagaaagcatgtttgagatccagaacagaataacgggttgtggagagaggtattgaggataggagagtatatgggtttggcaccatggggtggatagggaaaacaatttggttgataaggggcagatcctgaactaacctgtaaggcttgtctggttttaggacaggtaaaatgggggaattgtaaggagagttttaggctgtaaaagaccatgctgtagcaggccagtgataacaaagctttaatccttttaaagcgtgctgcgggatgggatattggccttgagtggggtaaaggtgattaggttttaatgagatggtaaagggtgcatgatcagtcaccaaggagggagtagaggtgtcctatacttgtgggttaaggtggggagatacaaggggaaaatgtaaaggaggctttgaactgggggaaaaggtggcagtgaggtgtggctgtagcccaggaataatcagggaagcagataatttagttaaagtgtctcggcctaataagggaactgggcaggtggagataactaaaaggagtgcttaaaagagtattgtctaagctgacaccagagttggggagttttaagaggtttagaagcctggccgtcaatacccgcaacagttatggaggcaaaggaaacaggcccttgaaaagaaggtaatgtggagtgggtagccttcgtattgattaagaaggggacggacttgacctccactgtgagagtcacctaaagcatctgtgatggtccaggaagcttccgaggcaatcaggcagcgtcgatcgtcagccgctaagccaagaagatctgggaaggagtcagagagccttgggccagagttccaggggctctgggagtggctgccaggtgagttgaacagtccaatttccagtggggtcctgcacagatgggacatggcttaggaggaatcccgggctgcgggcattccttggcccagtggccagatttccggcacttgtagcaagctcctgggggacgcaggcctggaggaatgcctggccgctgcagttcaggcatttggaagttcttctgtgctggagatatggctggggtttgtctcacagtggaggcaaggaattgcaactcagaaatatgttgctacttggctgcctctaccctaacattgtacacctttaaggtgagtttaattaagtcctgttgtggggtttgggggccggaatttaatttttggagctttatttaatgtcgggagcagattgggtaataaaataaaatgcatgttgagaataagacggccttctgacctttcagggtctagggctgtaaagcatctcagggttgctgccaaacgagccacaaactgggctgggtttttatattcgatgaaaaagagcctaaatgctaactgattttgggagaggtcagataaagaaacagaagcattagccttgactatgcctttagctccagccatctttttaagaggaaattgctgggcaggtgggggagggctagtcgcagaacgaaactgtaagccagaccgggtgtgaggaggggaggtgattaaaggattatagggtggtggagcagaggctgaggaagaattgggacctggctcggcctggcggggagcagcctggggaggaggggagaggtcagatgggtctgtagaaaaggaagattagaaagactcagccacacttggggttgggactgagaggacaggtgggagggaaagaaggaggatttgggatgagtcgcattgggaacagagactacagagggaacaatgtataaaagaatgcctggacgtcaggcacctcagaccgtttgcccattttacggcaataattatctagatcttgtaggatggaaaaattgaaagtggcattttctggctatttggaaccactgtcgagtttgtattggggtcaagcagcattgtagaagaaaataaggtgttcaggttttaggtcagatgggagttgaagaggttttaagttcttgagaacacaggctaagggagaaggaggaatggagggtggaaggctgcccatagtgaaggaggcaagcccagagaaaagagagtagagacacggagagaaggggttggggggtgcttgccccccaggaaagtggagaaggggtagagacatggagagaaggggtcgggggttcctccccaccagagaagcagtactttctgctaagggtgaaggaccaaggcaggtgtctccacgtggtcagacacctctgaaacgtgggtgaataatcaggcaggtgtccctgcaatgattaaacaccaagggaaggctgccttctggagtccgtgaccggcaccagagttttgagtccatggataaaatgcctctcctttgtctctacccgaaaaggaaaggaactgaaattaagagaagggagagactgaagtgtggcactaagattaaaaggagaaagaggttgagggatagtgagagaggttggagaagagagtaaaaaaaaggtcgcttactagatttaaaattggtgagatgttccttgggctggttagtctgaggaccagaggtcataggtggatctttctctcagagcaaagagtaggaggagaggggattgatctcccaagggaggtcccctgatcccagccatggcaccaaaatttcacttgtgtccatgtgaagagaccaccaaacaggctttgtgtgagcaacaaggctgtttatttcacctgggtgcaggcgggctgagtctgaaaagagtcagcaaagggagatggggtggggacattttataagatttgggtaggtaaaggaaaattacagtcaaagggggttgttctcggtgggcagggtggggggggtcacaaggtgctcagtgggggagcttttgagccaggatgagccaggcaaaggaatttcacaaggtaatgtcctcagttaaggcaggaacaggctattttcacttcttttgtcattcttctgttacttcaggccatctggatgtatacgtgcaggtcacaggggatggcttagcttgggctcagaggtctgacaatcaccttctaattttcctccctatctccttccctgcctccatcctgcctttgttttcttcacccccttatttcctttctctccaggaacgctgacttagcaccttattttgcctgtcactttactagaccctgtggactttgcaaaagtagatgagacaaataacgatctagctgagagtgttgccatttatttgaggaaacaggcatgatcacatggaagagttaaaacagtcttggaacaatgtgcattccagtgtagaaatgtctcgcagagatggtccttctagatgatttctgatctctttagagagtcagtgtgtctcatacttgttacgtttgcataggctcttttccagtaaaaaaaaggaaattagtttattgctctgtgtgtgtgtggtgagagagcttttatttaaaaatgcatatattaggggtgtttcaggtacttgttgctacccttaacttagctattgctttagcaagtcaaattttcttatattaccctctgtaaagacatttctgttctcagcctatgagccaagtcatgtgacactgaatgattgctgaataagccttgagccctgggtcaggcattctgaggttcacaaaagaaaacctacccagtggcctattttatgaacccttggttcattccaggcaaagcttcccatgaggtctctgcactctcctctggcttgatctctagtgaaaacttcctaggcagcctgcgtcctactgggtctactcacctagagggcttctgtctgctttcagtaattagggcaagacagctgacacagatctacctgggaattaccagtctcccttgcacactctctggcttccccaggcactgtgcctggtaattaacctcccattatatcattcagaaggcaggtggctcatgatgccatcttctagcatgactgacctgaggtgctctgaagaaacctggaggctgacagtgtcagacaggaataatgagtacaggaaaagagccctcaggaattacctcaggatgctgcccagctcctcccactccagcttctcaacacatcctagagaagcaattagcactgggaggtgatggagaagcaaggctgtgtgcaggaaccggctgcccgatttagcaaatgagaggtgggggctatctcccatgcagagatagccgtatttgggagaatcgttacctggagagaaacagacttctaccttttcctaggaagtctatgacctatgatttcttagaaatggtattttttttttcttcagaggaaggagttgagtttacagtagattttgaatgtggctgtaataaaacggcctttaaattttagaatttgtgtgaagaaatctattatatgcctccctaaaccccaatttccttttctgagttgtgggttttgggagctttaatttttggggtctagttctccattttaataaggcaggaataaaacccactggcacctcatagcttgtaacagctcccagcaggatgaggggaggctgagctgccaggtttcaaatgtgggctgcgcttaggtatcctgaagcctgtcagtcatacataccacagtcgcagagggaagtcagcagtggtatgcaagtctcagtgggagaaacaacttttagaaaatgtatttatattttccccttatctaggtgctttttctgttgttgaagcagagactctgagacacatgattttcagatttagtaagtaattaaaatttttctcaatttcacgggctaggcatgtgctgccaagcagcatcaacaaccaactgttctatgcattaatcattttttaaactagctttagttgagctaataacattctatatgccaaactctagacattgacctataaaaagtttactcgttacattcaaggtactctgaatcatttgggtaaaactctgaatcgtttgggtaaaacgtgtaacaaaacttattgtaattgatataatgtgtattgtgacagaagtgttatctaattattatttaacaaaacagatgcaaggaggcaaggtctttccgggcaaagagaggagcacgtggaaaggaatggagatacatatgtgcaaatggcatgttccgctcactattacagaggggaagggcagtgagtgggactgaaaacgcaggtgaggacagatatttaaggaacatgccatgctacagagtatggatttattctgaagttaacatttatataagaatagtaagcagatgtaactggtttgatatatttcactatcttggagtacagataagattgcaacaaaagaataaaaatatcctagcaatgttttaggatacatactggaaacttctctggagggacagacatgaatgggaatggagaggaacacacagggaatccagcagtgtcttctatatttatttggttgtttaacacaaagttctgaagcaagttagtacagcattagatttgattaaactggtgatgagtaaagatttgacaataaaataattttaaggggctgtatctttttaacattcaaattcactcaagtctccattcgtgcaacatggcaagtgttataggctgagttttatcatctcaccaaaattcatgtattgaagccctaatgcctggtacctaagaatgtgactgtatttggagataggctcgttgttgttgttgttgttgttgttgttgtttgagacagggtctccctctgttgtccaggctggagtaccgtggtgcagtcacggctcactgaagcctcagcatcccagagttcaggtgatcctcctaagtagcttggactatgcgggactacaggcatgagccaccatacccagctaattttttattttctgtagagatgggttttcaccatgttacccaggctgatctcaaattcctgggctgccttcctggccctcccaaagtgctgggtttacaggtgttagccacctcacctggcctgaaaataagctgtttaaagggggtaattaaggtagaatgaggtcagtagagtgaaccataatccaatatgactggtgactttagaagaggaggatatgaggacacagatatctgcagaggccatgtgaggacacagggagaggacggccatctacaagtgaaggagagaggatgcagaatgaactagtcctgttgatactctgatctctaacttctaacccccagaactgtgagaacataaatttctattgtttaagccacctagtctgttgcactttgttatggcagcccaagaaaattaacacagcaaaggttgtagagtgtctctcttggggctttctcaatacctagcaattgtctaagaacccctgggaattattcagttcaaaacagctgcaactgcttctaggctaaacaagaacttaagaatcagatctggccatgagcaaatgccagttttttgtttaccttgtttcttttacaatcaatggtgcaattgaggactagtgctgcactagtgaacatttcctgatcagatgcagcaaagacatctttactggtctgaatcccactcccacgagcattcccttcatttaaagatgctctagattggacttaaaaggtcatagttctttactctacatttaaggcccagtcactgtgcctgaagttctcctctaggctaaggagtagttgataatgtcagccacatgcccattctcatgcctatttaggtcctattgttgagcctacctcgccagtcaggctctccttcccctcttggtacactccccttcagtcctttctgggtcagtggatcttttgtgaaaattaatcaattcatgagtaaaacttgaacctcaagaagaaaggagacagctcttaatccctccctctccagaggctcctaagtccctgtgcacacttttctgcatttttcctcataccacagttctgcttatccagggtattaggtgcctagctgctttacattggcctaaggaacctgttaagcaaatctctgcctcataaataggtctggtttatggtgctttgctgttctatcattaaaaaaaagtagctgaagtttttttttaaatggcaagttttcttgattaaattccaaatactcaatatagtcatacaaaaaagactcacatgatcaaaacttcctaattccaagcagtctctaaattgccactaacattatcttttaaaaataaaaataatggcaatttcctttttcattgcttacaggacacaatctaaattatttctcaactcggctccaactaaaaacaaaggaacacgacaaacaaatttctactcctctttcaaggttcagctcaagtattcactgccatttatatgctcccaaataaattgactcatacttgcttctttgattcctcattatttttctgaagtttgtctactctacttataaaaggaaagccaggagctcttcttttttcatcttaacaaccacaaagcatagcatagtgttggcacatagcaaataaataaataaatggaatagatatttgtaaagtattgctgattgcaatgtggattatatcttagatgtgtctttaaagtttcatcccccaaaaagcagagaatcaaagtaaaaataataagccatttaagcaagaaatgatgtgtctggactaaggaaataatagtgaagatgaagaactacagattttgcagatatataattcgtaagacttggtatttgattgggtgaaaggtagtatgaagaagaaaaaatgattaccaaatgagtttacagaaaattgaggtaaagttgtgtgttctatttctgatagaacataagaaaaccagtaagtttagtgtgctcagattatttttagtacctactaagtgtgaggaaatatgttttgccattaaagaactcagtctagttggaagtgaagacatgcatctaaattgataaataaaactgttaaatggcttagaaaaaatatcgaattgataaatgatgataagcaaacattatggagaaaaatataccatctacctcccagaggaaaataaaaatcaacattgcaattgcgatgtggtctggaaccaactgctccattgctctgagcttgggttctgaaatggtaattaatatttttattgatttaacatctggacactaggaaagctgctgataaattgccttgagctcactaggcattgctcaggattctttctgctggggaaaaccccagctcatgctggtttttgcagggaaatatcttgggtcatgtaactgaaaaagctagagacaatgggatacagaggtagagtatcaggcaagactcttcaaaaaatgccattaatataataaaaaggcaactcacagatgagcaaaaagtattttgtattttctctatatacatagacaatacacacacaatactatattacataactataagacaatttatactctcaccatatattttatatatctttatgattgtttataccttttggaatgagtattcttacattaataagaaggcaaacaactcaataacaataacagaagattgaaacagatacttcccaaagaagatatataagatacacagtaaaagtatatgcaagttattatatctttacaatggaatactgagctattaataataagatatgaactgatagagcaacctgatgaatgtcaaaagcattatattaagtgaaagaaggcagacacaaaagacccatactgtatcattttatttatatgatattctagaatagcaaaacaaacctgttgtgatagaaagcagattagtagttttctttagattaatgacagaaatggtagtggcgatttattacaaatgtgcctaaaagagtttttgtggaggtgagaatgttctatgtcttgattatgatgtgtttataaaagtgcacttccaagagtgctcaaactgtacacttagaatgggtacactttattgtactcaaattataaattaataaaatatattaaaaagtcaaagtaatacaattagggctctttgggtaaaactaccaaatgaacaaaccactattatgtaattatgcaaagaataaaaggtgaaagtatttaattatctacaaaatgaaatgctgcagaggggaaataacttaaaaatgaaatgaacaaacttatgagattattacaggtaaacctatggaaatgtatttgaaatcctatgcaaaaatactatttatcataattgaccctggttgtaatagaatgtttcaacaaactgattgacgtataaaatgataaagaattcaaacaactacctgctcaaaaatcactcaaactagatgattatgtaggaaatttgaccaattcttcaaagaccattcttttttaaattgttccaaagcatagaaataaaataagaaaaagtttgaaataaatgtaatattgataactaagcttgacaaagacacacacacaaaactaggaaatcatgtttccttatgaatattgattcaagaatcctaagtatttgcaaatgaaacctgccaacaaggtgtcaaggaaataatacatcatcaccaaaccatatttgctctggagattaaagactcatattaagaaatctattaatgtaaatccttatattagtattaggaaatatattaatataaatccttatattaatagttctcaagtaaataatcatttgattccattgatatgttccacaaagttcaacacaaaagagaaacaagtgaccctacctctatgttgattgataacatatttatatagaaaaacttaatctgagaaaataatattttgaaggtacactcaataaaatgttctaagaaaaaaggaaatgcacagaaattgtgagctttattaagttttattggtgatggcattggtatagacattttaacactggtttttgtactgtaggatgaaagaaagggtaaatatggaataggaaaaggcaaggacaaatgctatggtattgtatttgaatttttgttagcattaatgattaaatacatgcaattaagccatggaaagattcagaagcaatgttactctggtagcgataagtatactttttccccagatcttggcttctaaacatcatttttcactacaaataactggaatccttagagatataactgaatctatgtctttggcagagtaagtacaaagtgaccttgaaacattttgttgtggcagagagtaaaggagtatcatgaattgagggtacatatcaaaatgatccagaatccagcttaactggactcccattatcaaaatttgagatgatttgattattaacaataatcataatcttgcttctagctatgaaggagtagtttgcatctgactagtattacaactaagaacaactataaaacctggattttaattttaatttaatttaattttattattttttgctcatatggggactgacaactataaaacctggatttttaaaagcagtggtttgaaatcattagagagaaatcaaggcaaacaggatttaaggagccatgatcccaaaagaaaaaaaaaagggcattgaggttagttgtagatcagcaccactatttttcctcctgaaatttgtcaatttgcttcagtgcataaagcaggaggagaaatttaagtagtcttgctagaatgggatgtccccaaaaattggagttcaagacgcttagtcaaccaaatttgaggtattcagatccttacgtaaagaaaattgcagaaagaaaactcaagaaaatgtctaatgtcacttagactggtttagatttctggtctatgtctttctcccatgctggactcttcttgcccttgaatattggactccaagtttgtcagccttgagactcggactggcttccttgctcttcagctggcagatggcctattgtgggacctcgccttgtgattgtgtgagtcagtactccttaataaactcccctttatgtatacatctatcctattagttatgtccctctagagaactctgactaatacagattttggtattagtcaatgtttctgagaaaaaaaatcttaaaagttgttagagaataaaaacacattactttcaaagaagcaggtacaagactggctgtgaagaaaaagcattaactatataaaaagattaataaaatttacttcattaaaatttaaaaactttattcatcaaaagacatcattaaaaggatgaagaaattactcatacagtagagaagataccactttttaaaaaataaataagcaaaagtctttgagagagtttacaagatgacgatccatctgatcaaaaaaagagaaatgtcctcaacattgttaatcagcagaaaagtaaaaattaaaacctagtgaggtccactacacatccagagaaagtgttatacttaaaaaacgacattaacaaatgttgtcaaggagctctcatatgcagctgatgaaagtataaagtcggtgcaaccactttgaaactatttgtcaatatttaccaataataaacacatgcagatctatgactcacaattctactctcatgtgtatactaacataaatgtaaatttaaactcaacaaagacatgaataagaatgttcatagaagaataaggcaatattgcctcacaccagaaatatcgtaggtatccaatcacagtaaaggtgtaaggtcaaagaactcttgaaactcaacagtaaaagaaaaaaatccaattaggaaacgaacagaaggcatgaatagagacattccaccaaagaggatatacagatggcaaataagcacatgataatatgttcaacatcagtagccactagtgacatgcaaatttaaactacaataagatgtcataacatatctgtcataatggataaaatttgtttatgatatcatcaaatactgacaagaattcagaaaaactggaatcaaacattgctgttgggaatgtaaactgttacagccactcttgaaaatagtaggcaatttcttataaaataaaacatacaaccactgtaaacccagcatttgtgttcttgggcatttatgccatagaataaaagcttatgctcacacaaaaaccaatacataaatattcataacacttacgtgtaataacccaaaactgtaaacaaactgcaaattgtcaatgggcaaatggctaacagacagtgatacattcttaccatggaatattactcagcaattaaaagggaaatatactgagtgaaaaaaagcgaatcccaaatggttacatacagtataactccatttatgtaacattattgaattgacaaaattaaagataaggaaaacagattagtggttgccaggtgttgcggatgtggaaggtagatgtggttataaaagtgcaacacaactgcagggcgcggtggctcatgctagtaatcccagcactttgggaggccgaggtgggcagatcacgaggtcaggagatcgagaccatcctggctaacacgttgaaactctgtctctactaaaaatacaaaaaattaaccgggcatagtggcggctgcctgtagtcccagctacttgggaggctgaggcaagagaatggcatgaacccgggaggcggagcttgcagtcagctgagattgcgccactgtactccagcctgggcgacagagcgagactccatctcaaaaaaaaaaaaaaaaaaaaaaggcaacacaacagatccttgaggtgagagaaatgttctttactataatgatggatacacaaacttaacataataaaattgcaagaactaaagacacacacagaaacacaactggaaacgttgactaagattggtggattacttcaatatcaatttttcatggagaaacctggtaaaaggtacacaggatctctctattactttttacaagtgcaaatcaaagccaatgatatataaaatagataatgaatcatgaaaatttgggttttataccaggaatcaaaggttcatcaatgtgtttcaccatgttaatcaaatactttcttttttttttctttttttattattattgtactttaagttttagggtacatgtacacaacatgcaggttagttacatatgtatacatgtgccatgctggtgtgctgcacccactaactcgtcatctagcattaggtatatctcccaatgctatccctcccccctcctcccaccccacaacagtccccagagtgtcacgttccccttcctgtgtccatgtgttctcattgttcagttcccacctatgagtgagaatatgcggtgtttggttttttgttcttgcaatagtttgctgagaatgatgatttccaatttcatccatgtccctacaaaggacatgaactcatcattttttatggctgcatagtattccatggtgtatatgtgccacattttcttaatccagtctatcattgttggacatttggattggttccaagtctttgctattgtgaataatgccacaataaacatatgtgtgcatgtgtctttacagcagcatgatttataatcctttgggtatatacccagtaatgggatggctgggtcaaatggtatttctagttctagatccctgaggaatcgccacactgtcttccacaatcattgaactagtttacagtcccaccaacagtgtaaaagtgttcctatttcttcacatcctctccagcacctgttgtttcctgactttttaatgattgccattctaactggtgtgagatggtatctcattgtggttttgatttgcatttctctgatggccagtgatggcgagcgttttttcatgtgttttttggctgcataaatgtcttcttctgagaaatgtctgtccatttccttcgcccactttttgatggggttgtttgtttttttcttgtaaatttgagttcattgtagattctggatagtagccctttgtcagatgagtaggttgcaaaaattttctcccattttgtaggttgcctgttcactctgatggtactttattttgctgtgcagaagctcttaagtttaattagatcccatttgtcaattttggctttggttgccattgcttttggtgttttagacatgaagtccttgcccatgcctatgtcctgaatagtaatgcctaggttttcttctagggttgttatggttttaggtctaacatttaagtctttcatccatcttgaattgatttttgtataaggtgtaaggaagggatccagtttcagctttctacatatggctagccagttttcccagcaccatttattaaatagggaatcatttccccattgcttgtttttctcaggtttgtcaaagatcagatagttgtagatatgcggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgcgggctcttttttgcttccatatgaacttcaaagtagttttttccaattctgtgaagaaagtcattggtagcttcatgggaatggtattgaatctgtaaattaccttgggcagtatggccattttcacgatattgattcttcctacccttgagcatggaatgttcttccatttgtttgtatcctcttttatttccttgagcagtggtttgtagttctccttgaagaggtccttcacatcccttgtaagttggattcctaggtattttattctctttgaagcaattgtgaataggagttcactcatgatttggctctctgtttgtctgttattggtgtataagaatgcttgtgatttttgtacattgattttgtatcctgagacattgctgaagttgcttatcagcttaaggagattttgggctgagacaatggggttttctcgatatacagtcatgtcatctgcaaacagggacaatttgacttcctcttttcctaattgaataccctttatttccttctcctgcctaattgccctggccagaacttccaacactatgttgaataggagtggtgagagaggacatccctgtcttgtgccagttttcaaagggaatgcttccagtttttgcccattcagtatgatgttggctgtgggtttgtcatagatagctcttattattttgagatacgtcccatcaatatctaatttgctgagagtttttagcatgaagcgtttttgaattttgtcaaaggccttttctgcatctattgagataatcatgtggtttttgtctttggttctgtttatatgctggattacatttattgatttgtgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgccccagctttggtatcaggatgatgctggcctcataaaatgagttagggaggattccctctttttctattgattggaatagtttcagaaggaatggtaccagttcctccttgtacctctggtggaattgggctgtgaatccatcttgtcctggactctttttggttggtaagctatagattattgccacaatttcagctcctgttattggtctattcagagattcaacttcttcctggtttagacttgggagagtgtatgtgttgaggaatttatccatttcatctagattttctagtttatttgcgtagaggtgtttttgtattctctgatggtagtttgtatttctgtggaatcggtggttatatcctctttatcattttttattgcgtctatttgattcttctctctttttttctttattagtcttgctagcagtctatcaattttgttgatcctttcaaaaaaccagcttctggattcaataattttttgaagagttttttgtgtctctatttccttcagttctgctctgattttagttatttcttgccttctgctagtttttgcatgtgtttgctcttgcttttctagttcttttaattgtgatgttaggttgacaattttagatctctcctgctttctcttgtgggcatttagtgctgtaaatttctctctacacactgccttaaatgtgtcccagagattttggtacattgtgtctttttctcattggtttcaaagaacatctttatttctgccttcatttcgttatgtacccagtagtcattcaggagcaggttgttcagtttccatgtagttgagtggttttgagtgagattcttaatcctgagttctagtttgattgcactgtggtctgagagatagtttgttataacttctgttcttttacatttgctgaggagagctttacctccatgtatgtggtcaattttggaataggtgtggtgtggtgctgaaaaaaatgtatattctgttgatttggggtggagagttctgtagatgtctattaggtctgcttggtgcagagctgagttcaattcctggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttacctcttcttgttgaattgatgcctttaccattatgtaatggccttctttgtctcttttgatctttgttggtttaaagtctgttttatcagagactaggactgcaaaccctgcctttttttgttttccatttgcttggtagatcttcctccatccttttattttaagcctatgtgtgtctctgcatgtgagatgggtttcctgaataccgcacactgatgggtcttgactctttatccaatttgccagtctgtgtcttttaattggagcatttagcccatttacatttaaagttaatattgttatgtgtgaatttgatcctgtcattatgatgttagctggttattttgctcgttagttgatgcagtttcttcctagtctcgatggtctttacattttggcatgattttgtagcagctggtaccggttgttcctttcaatgtttagcacttccttcaggagctcttttagggcaggcctggtggtgacaaaatctctcagcatttgcttgtctgtaaagtattttatttctccttcgcttatgaagcttagtttggctggatatgaaattctgggttgaaaattcttttctttaagaatgttgaatattggcccccactcccttctggcttgtagagtttctgccgagagatccgctgttagtctgatgggtttccctttgagggtaacccgacctttctctctggctgcccttaacattttttccttcatttcaactttggcgaatctgacaattatgtatcttggagttgctcttctcgaggagtatctttgtggcattctctatatttcctgaatctgaatgttggcctgccttgctagattggggaagttctcctggataatatcctgcagagtgttttccaacttggttccattctccctgtcactttcatgtacaccaatcagacgtagatttggtcttttcacatagtcccatatttcttggaggctttgttcatttctttttattcttttttctctaaacttctcctctcgcttcatttcattcatttcatcttccatcggtgataccctttcttccagttgatcgcatcggctcctgaggcttctgcattcttcatgtagttttcgagccttggctttcagctccattatcccctttaagcacttctctgtattggttatgctagttatacattcttctaaatttttttcaaagttttcaacttatttgcctttggtttgaatttcctcctgtagctcggagtagtttgatcgtctgaagccttcttctctcagcttgtcaaagtcattctctttccagctttgttccgttgctggtgaggaactgcattcctttggaggaggagaggcgctctgctttttagagtttccagtttttctgttctgttttttccccatctttgtggttttatctacttttggtctttgattatggtgatgaacagatgggtttttggtgtggatgtcctttctttttgttagttttccttctaacagacaggaccctcagctgcaggtctgttggagtttgctagaggtccactccagaccctgtttgcctgggtatcagcagtggtgtctgcagaacagtggtttttcttgaaccgcgcatgctgctgtctgatcgttcttctggaagttttgtctcagaggagtaccaggccgagtgaggtgtcagtctgcccctgctggggggtgcctcccagttaggctgctcaggggtcaggggtcagggacccacttgaggaggcagtctgcccattctcagatctccagctgcatgctgggagaaccactgctctcttcaaagctgtcagacagggacatttaagtctgcagaggttactgctgtctttttgtttgtctgttccctgcccccagaggtggagcctacagaggcaggcaggcaggcctccttgagctgtggtgggctccacccagttggagcttcccagctgctttgtttacctaagcaagcctgggcaatggcgggcgcccctcccccagcctcgctgccgccttgcagtttgatctcagactgctgtgctagcaatcagcgagactccatgggcgtaggaccctcccagccagttgcgggatataatctcctggtgcgccgttttttaaggccgtcagaaaagcgcagtattcaggtgggagtgacccaattttgcaggtgccgtctgtcacccctttctttgactaggaaagggaactccctgaccccttgtgcttcccaggtgaggcaatgcctcaccctgcttaggctcgcacacggtgcacgcacccactgacctgcgcccactgtctggcactccttagtgagatgaacccagtacctcagatggaaatgcagaaatcacccgtcttctgcgtcgctcacactgggagctgtagactggagctgttcctattcagccattttgagatcgttatctcaaatactttcttaatggatgcaaaaaaaaactttgacaaaagttaatatgcaccacaatttaaaaaaaactcagaaaactagaaatagaaaggaaactttctcaagctagtaaagaatatctataaaatcttcgtttattttattttaatggtctgattgttatcaaaaatatttttgaattaatgcatgaatttagcaaactcagtgtcaatttaaaaaatgtgaggtcattgcgcaaaaatcaattgtatttttatatataaacattgaactgaaaaatgagtatccaggccaattatgtaaaatgtctcacaatttagatttgccagctttgttatctcgagatttgattcagattatatatttttgacaaccacctgaatatcctattctccaattaactttcacctgttgattttagtaccaattaatgatttctctgaatcaattattactgtggtggttgtaaaatggcttttgaaaacttctgcatttactagttgtcattcttctataaacaacacttttcctataagaattttagaagaaaacggccgggtgcagtggctcatgtctgtaatcccagcactttgggaggctgaggcgggcggatcatgaggtcaggagtttcatttcttttcctttttttttttttttttttttgtgacagagtcttgctctgtagcccaggctggagtgcagtggagcgatcttggctcactgcaacctccgcctcccgggttcacaccattctcctgcctcagcctcctgagtaggtgggattacaggtgccctccaccacgcccagctaattttttgtttttttagtggagacgggatttcactgtgttagccaggatggtctcgatctcctgacctcgtgatccgccagcttcggcctctcaaagtgctgggattacaggtgtgagccagcgcacctggctgttgtgttgcatttttataaccacatctaccttccacatccccaacacctggcaaccactaatctattttccatatctttaattttgtcaggagtttaagaccagtctgaccaacatggtgaaaccctgtctctactaaaaatacaaaaattagccagacgtggtgctgcgtgcctgtaatcccagctactcaggaggctgaggcaggagaatagcttgaacccaggaggcagaggttgcagtgagccaaaatcgcgccattgcactccagcctggcgacacagcgagactccatctttagaaggaaacataggaaacaccattctgtagattggcctttggaaatgatttatgagtaagtcctcaaaatcacctgcaacaaaaaaattgacaaatgggacctaattaaatgaaagagcttccacacagcaaaataaactgtcaatagagtaaacagacagcctacagaatgggaaaaaatattagtaaactatgcatctgacaaatgtctaatatccagactctataaggaatttaaataattgaacaagcaaaaaacacacagccccattaaaaagtgggcagaagactgaacacttttcaaaagaagacatataagtagccaacatacatatgaaaaaaatgctccatatcacttattatcagaaaaatccaaatcaataccacaatgaggcatctcacaccagtcagaatggctattattaaaaagtcaaaaaacaacagatttggcaaggctgcagagaaaagggaacacatacactgttggtgaaaatataaatgagttcagccactgtggaaagtaggttagagatttctcaaagagcgtaaagcagagctaccatttgacctagcaatcccgttactcggtatatacccaaaggaaactacatcattctaccaaaaagacacatgcactcatgtgttcatcgctgtactattcacagtagcaaagacatgtaatcaagctaggtgcccatcaatgatggattggattaaaaaatgtgactatatataatatatatagttatatacataagttatatacacaatataattataatatatatctcatatgtatatcacatatatgatggaatactacacagccacctacatagtaggtgtaaatatgagatatatgcgatattttggttgaggcatacaatatgtaataatcacatcatggaaaattggatattcatcccctgaagcatttatactttgtgttataaacaatccatttatactcttctggttatttctaaatgtatgattaagtcattattgactctagtctctccgttgtgctgtcaaatactaggatctattcattctttctaactattttttttgtgcccattaatcatctccatctccaccccaccccacactacctttcccattctctgccaaccatccttctattctgtatctccatgagttcaatcgttttgatttttagatcccataagtaagtgagaacatgagatgtttgtctttctgtgcctggtttatttcatccagttctttccatgttgttgcaaatgacagaatttcattcttttttatagctgaatagtactacattacacattttctttattcattcatctgctaatggactcttagggtgcttccaaatcttggccattatgaacagagctaccacaaacatggaaatgtagatatctctttgataaaatgatttccttccttttgggtatatacccagcaacggaattgctggatcacgtggtagccctgttttcagttttatgaggaacctctaaagtgttcttcatagtggttgtactaatatacattcttatcagaagtatatgagtttctttttctccatatattccccagcatttgctatagcctgacttttgaataaaagccattttaactggggtgaggtgatagttcattatagttttgatttccatttctctgatgattaatgatgttgagcaccttttcatatccctgtttaccatttgtatatcttcttttgagaaatgtctattcaaatcttttgcccatttattttatcaaattattagagtggtttgagctcctttatattctggttattactaatcccttgtcagatgggtaataggtaaatattttctcccattctattggttatctcttcacttttttgagtgtttccttcactatgtaaaagctttttaggttgatgtgatcccatttgttcatgtttgctttagtagcctgtgcttgtggggtattgctcaagaaatttttgcccagatcaatgtcctggagagtttcatcaatgttttctcacagaagtttcatagtttgaggtcttagatttcagtatttaattcattttgatttgatttttgtataaggtgagagatatggatcaagtttcattcttttatatagggatatccagttttcccagcatcatttattgaagagattgtattttttctgatgtatgttcttggcacctttgtcaaaaatgagtttactgtaggtgtttagatttgtttctgggttctctattctgttcctttggtctatgggtctgtttttaagccaggaccatgctgttttggtatagctctgtagcacaatttgaagtcaggtaatgtaattcctccagttttgttctttgtgcttaggatagttttggctattctggtccttttgtgattctatagaaattttagtatttttttttctatttctgtgatgaatgtcattagtatcttgatagggaattaattgaatctgtatattgctatgggtaatatggacagtttaacaacattgattcttccagtccattaacatggaatatatttacttttttagtattcttttagatttttatcagtgttttgtaggttttttttttgtagagagctttcacttctttcattaattcctagatatttaattttatttgttactattataaatggaaaaacattttttattacttttcagatttttgcctttgggatatagaaatattactgattttgtatgatgtttttgtatccttacaactttacttaattttttaaaatattaactaacatttttctctcattttttttaacttttatgtttaggggtacaagctcaagtttattacataggtaggcttatgtcatcagggtttgttgtacagagtattttgtcacactcagttattaagcctaacacccattagttctttttcctgatcctctccttcctctcactctataccctccaaaaggcccagtgtgtgttgtgcccctctgtgcatccctgtgttctcatcacttaactcccacttataagtgaggacatgaagtatttgtttttctgttccccccaaaatataaatcattgtattataaagacacatgcatgcatatgttcattgcagcactgttcacaatagtaaagacatggaatcaacctaaatgcccatcaactatagactgggtaaagaaaatgtggtacacatacaccatggaatactgtatggctataaaaaagaatgatatcatgttctttgcagggagatgagtggagctggaggccattatccttagcaaactttactgaatttggttatcagttctaatagttgttttttttttttttttttttttttttgtggggtctttaggtttttccaaatacagaatcatgtcatctgcaaataagaatagtttggcttcttcctttccaatttggatgccgtttatttcttcttcttgtgtgattgctctagctagaatttccagtactatattgaataacagtggtgaaagtgggcatcttattgtgtccagatctaagaggaaagattttcagtttttccccattcagtacaatactagctgtgggtctgtcatatacagcttttattacattcagatatgttccttctgtactcttttttttttgagggtttttttttaatcataaagtgatgttaaattagttcaaatgcttttttcagcatcagttgaaataatcttgtgatttttatccttcattctgttgatatgatctatcacattgattgatttgcatgtcgagccatccttacatccctgggataccactttgtcatggagaatgatctttccaatgtgttgttgaattctgtttgctagtatttgttaaggatttttgcaccatcattcatcagagatattggcctgtagttttctttttttgatgtgtctttatctggttttgatatccatttaatactggctttatagaatgagtttgaaagtattctctttcttggccaggtgcagtggctcatgcctgtaatcccagtactttgggagcccaaggtgggtggatcactttaggtcaggaatttgaaaataaaaaaagaatacttttttttttttttttgagatggagttttgctctgtcacccaggctggagtgcagtggcatgatctcagctcgctgcaacctcagcagtgtgaaaccctgcctctactaaaaatacaaaaattagttgagcgtaggtctgtagtctcagctcttgaaaggctgaggcatgaggatcgcttgaacccgagaggcagaggttgcagtgagccaagatcgtgccactgcacctcagcctgagtgacggagcaaaactctgtctcaaaataaataaataaataaataaataaataaataaataaataaataaataaattatctttctctatttttaggaacagtttgagtaggattagtattagttcttctttaaatgttttgtaaaattcagcagtgaagccaatgggtcctgggctttcctttactggaagactttttatcatggcctagattttattacttattattggtctgtttggtttttaatttcttcatggttcaatcttggtaggctgtatgtgtctaggaatttatctatttcatctagacttttcaatttattggcatatagttgctgacagcagccactaatgatcctttgagtttctgtggtaccagttgtaatgtctccattttcatctgattttacttatttgggtcttctctctttcttagtgtggctaaagttttgtcaattttatcttttcaataaaccaactttttgttttgttgatcttttgtattactttcttcttttcaaattcatttatttctgctctgatctttattatttatttccttctactaattttgggtttggtttgctcttggttttctagttctttaagacgcatcattaggttatttctttgaaatttttcctcttttttgatgtaggcacttttcactataaatttccctcttaatactgcttttgttgtatctcttaggttttcatatgttctgttttcattatcatttgtttcaagaaatttttatcaatttccttcttaatttcttcattggcccactggttgtttgggagcatattgtttaatttccttatgtttttatcatttccaaaagtcctcttgttattgatttctagtttcattcgattgtgttcagagaagatgctttatattatttcaattttttaatgttttaacacatttgtgacctaatatatggtctgttcaagggaataatccatgtgctgaggagaaaaatgtgtgttctgcagccattggatgaaatgttctgtaaatatctattaagtccatctgttctgtagtgcagattaagtccgatgtttctttgttgagtttctgtctgggatacctgtctggtgatgaaagtggggtgctgaagtcttcaggtattattgtattggagtctatttctctttagctctaataataaatggtttatatatctgggtgctccagtgttgggagcgtataaatgtataattatcatatcatcttgctgaattgacccctttatcattatataatgaccttctttgtctcttcttacagtttttgtctggaaatctattttgtctgatatatgtagagctacttctgctcttttttggttttcattggctctttttccatgtctttattttcagtctatgtgtgtctctattggtgaagtgtgtttcttgtagacaagagatcattgggtcttgattttatctattcagctcctctatgtcttttcattttatataccctgatacaaatggccaaagttacttgtcaatatcttcagttagagaacctttgagggtaaggcctacattcaagttgtctcaaagactcatttacctctgctctctctaacccatttcatatatactcattaaatgagagccatacaccaggcactggtctatgtgtatgtctacagtgctgaattagagagaagttcatgattcaaagacctgtgtgtttggaggagatagaccacaaacatttatattaagtactatcatatggataattctaggaccgaaaaaagagaaaattgaggtgatattttagataggtcatacaagactcatagggaaggttatatttgggcagagactgaatgaagtgaaaatgagtgtcataaattttctgttaaatatcatcttagtagagaaggctgtaacataaagagactgaagtaggagtgcatctgggaggtattcaaagagtaggagaaacagggaggctgatagaatatgagttcagagaagtacataggggctgtatttttccttgtgagccattttaagaactttagatgggaggcattttgagtgttgatagcagggaatgatattatatgatttacattttaaaggattccatttattgcttgggattaaggagaaaaggtggaaacagaatagctagaaggctattgcaagttgcaggggtcctggcaaccattatgccttagagcagtgtggtggtagcagaaatggtgagaatgaattggactctgggtgtatttcacagagaaagctgagaggatgtgctggcagattggatgtgcatttctatgaaagaaaaaaagtcatagatgactctaagatatttgatctgtggaacttggtcaattatggtaccatttacaaagatagagaaactagggatggagcaggtttgtggtataggtggaaaaattttaaaaactgagttacctgttaatcatccaagtgaaggtgtatttccagtttatggaaatcagttaggaaaagagtatagtgtggttagagaagagaagaggaaaaaaaatatgaattgcagagtacttcattttttagaagataaaaataattcatcaaagaaaatagaaaagaagtggtcagtgaggtaggagggaaatggaaaaaaatgaaatgtccttccaaaaataaaaaaaattgttttaaaaatgggaataattgagtatatcaatgttgctgttgagtgaaatgcagtcagttcttcatctgtgggggttcctcatcttcagattcaaccaatcaatctctgattgaaatatttaaataaacaataacaatttaaaaatacaaattctaaagatgtaacaactatttagcatttacattgtattagatattataagtaagctagagatgatttaaagtatgtatatggaggttatatgcaaatattacacaattttatataagaaacttgaacatgatagattttggtagctgcaggggtcctggaaccaatcccccatggataccaagggatggctctaatatgagaactgagaatttgctattgtcgctgctttctgctagggacagagacatgtcaggagtaggttcaaaatgagaaatggagacaatggatacagaaaactcttttgaggtgttttgccataaaggaaaatagataaatggggttattgtagaagagagatggaaggataaagggaggattttcttttaaaatcagagctatttcactatgtttgaatggtagtggggggaattcagtagagagaaaagatgatgtgggaaaagggtggacaatgctagagaaatatccttaaatgagaagcacgtgctgcagtactaaatttaagagttgacttttgataataacaggtctagcagtaagtgtatacgggtacagactggctcagtgaaataagaagcagggttattagctggcagaaaaaagttgataggggaaggtgaaggtctgtgcattactccgtttttacgctgctggtaaagatataccgaagactaggcaatttacaaaagaaagaggtgcaatggactcacagttctttgtggctggggaggccacacaatcgtggaggaaggtgaaaggcatgtctcatacggcagcagacaagagaagagagcttgtgcagggaaactcccctttacaaaaccatcagatctcatgagacttattcactatgacaagaatagcatgggaaagacatgtccccatgtttcaattacctcctaccaggtccctcccacaagtgggaattaccagggctatgattcaagatgagatttggatggggacatagccaaaccatatcagtctgaaaaagaggaaatcacagggaattgcggtgaccttcctctttataaaatatatattatatatatatataatatatattatatatatatataaaatacaatttaacaaaagatctgggtaacatatagagacagagctgaaattgtccaaggctgttgaaagcaggggtcttaaaacaaatgcagatttcaagggagttataaagaagccagtgtaagactagggtacgtaatagttaatcagcaaaatatgaatcataacataataagaaaagaactagagacagatgtccttgagacccatgaatagtagctttatatgcacatttttaaaattgtgaataaatataatgaagaagtggattatacgaccttagaaattatataactcctctctctctctctctttgcgtttgtgtgtgtgtgtgtgtatgtgtctatatattatatatcctttattaccaactaatttgagaatatgatgagatcactaaatggattttctccactgaaaagtacatttatgcacataggtacaatatcatacatgaagtattcacagaccaatggataagaattctgatcctacccctaaatgtattctgagtaaactgacctttcctctctcatgtccatggttgtgtatttcatcctctctgcttgcagtgcttatcttcattttctcacctaccaagctgctgctcctccttcaaattcgaagttaagctttgccttgtctgtgaagctttttatgactcttaagaaaccctaggggcaccttcttccaagtgtctgatctttccctattaacatttatcattttgctttgtaactgttggtttgcaagtctgcttaatccatcctgctgtgggttctttgaaggcaggattaaatctcttcatttctgaatcattattacccagattcgtgcccagcaagttttgaataaattttgcaaataaagaaaagtgagtcctcaaaggggttaggggacttaagcaagtcagtgtcagaactaggccaaaactatggtgttttctttgctgagtttaagtttctctttattctgcttgaatctacctgcttttaaggaagaaaacatttttacaccaggaaatagctgatggggcaaaaatggactaaagtgcacattgataggtcatctataagtattagtgctcccccttgtggcatctcaggaaggtggaggtgaaagtgaccatggacttatcaaggtctgttaggaagcaagatggatctttagctgggagagaacatctgtgccccggcctgtgttcccccaggaagaagttaatcagaagatgtttcctttcaccacaagcaaaaattatctttatttcaagtcttcaatcattttcattagattccacaggcatctgagtagattctttaggcagatattctgacttacattattgagaatataagtcctcattataacctgttgaaataggttgtctcattctactgttaccaggtgagacaactgaggttcaggatgttaaagtaatcattgcaagggtggacagcctggagcgcttgtctttgaagtcctctatgtagcatactttctaccatactctgcctgtttagacaataaaagtttggattgctgcaaaacaagctagctattgttgttgccagaattctgttagctaccaagtaggcaaaggaagctggcattcagtggacagctcaggtgcagaaatcaaagctgctttttttccctgctgcttttttctatatggagattgcacattgccgaaatattagctgaagacaagggctaccccattgggaggtggtggatatggtggaaggatggctgaaagtacaaggatctctatctctgatgcacaagcccagacctcccaagtggccagtgttaaagtcttaacattttacttggaacagaggctggaggagaaaggaaaagccttcagactgtcctcatgcaaaggctccaaagcccaactggaaacatttttcttctctaagactcaagacatttttttaaccgagccaggagcttaggaacacgcaacagctgatagggagcttttaggatgactgggtgctgtctttactggcagagtcaaatattagctttgatttgtaatgttttcgtaactcactttcctctcctggagtcttatcccccttagtagatctaacaagcatctaaatcaccacaagagtatgattaacacatttccatatcctgaacccctgtaaggcaatgatcaaaatagtagctgatacctatcgatcacttattatgtgataggtgctttaccttcatgatgatctcattcaatccttatagcaaaccatattgtagtgaccaagacagattcagaaaacttgcccaaggttacaatgagtagtcagtggatctgagactaaaagtaaacaatctgactccacactacattacctaatgaactaaaaataaaaagagtatctgaggaactaagtctccacctgtaagactgctcacttagtttactcagcacgtttgagaaccatagaagagaaaagctaaagcttctcatttctctcactgtatagctggttagatagatgagtagatagatgagtactagcccatgatctagccagccacatacttcttaagaaaaataatggcaattaaattatcaccaagactcaacattgtagagagattttataactgaaaaaatttgtaaaaaaaaaaaatacaggcaactgggtgtgtttggtactttgattttaaggtcgatctattattggttactaatttgctttgattgtcaatttcactttcagaaattcctggatgttgtgtctccacaactttccagaggttgccacatccatatctgtcttgtttcccacagaagccctgccgtccttcactgctcagtactatttctaataacatttccagtagtgccctgagggttgtacctcttgttgccctggtctctgccacctggccttattgcacatcaagagaggctcaaatttgtccccacccattcttaagccaatcaatatgcaggtaataaggcccatcagtaaaaaggattgaggaaggatcctccccaaaacacatggttgtcagggtacaaaccaggccttgccagcagggtaggtatgggtgatgggagaaattagcaatgaccaccaccattaatatgacttgttacatccagattgtggctgttgtaacaatcatggaggatagatctgtcttctaatctcaactctgccacttctgaactgtgtgactttgagaaagtcattttgccagtcagaacttcatttttctggtctcttaaattaggataataatacctaccaaatagccttgttgtattgtaaaacaagtaacagaccggggtcattctgtccttgaaattttaggatatacagataagggacactatgatgggttgagaccaggcatatcaggctttgcatcctaacttgctccacttagcaactgtgtgaatttgcagaaattttttcaactccctgaccctgtttcctcatccgtaacatgcagttgaaactacctaccatatggagtatagaaataagacagtatatataagtaactgcattaagacctggcatacagattataaatccgtttatttctcctactaaagttcccattattcttgactatttgatactggagagcaagaggggaagaggagattgtccctagtagtgcacttgtcttctatctcccacttaataccataacaataatagctactgctacggtcaccacttctaatatgactgcttttaccactagtgctgctgctgctgctgctattctggtattatttattgagcaggaactatgtagcaatatgtaaagggtactgcgatgtgctctttactgtgctattgattttaatctcagtatgtctgctttcaatcaattatattgcatggccttgaaaaatagccatttcattccagtcctgggtttttgcaggccagggttaatgcaagaagctttcattagtaaaccataaactctagaaggtgtgaataataggacttggcctatgcatctttctttttatccatctcggtcctagcacctgctgatgagtccttctttgagtgatttcacagtttgtcatcctaagtgttctgggctcttagtgtttcactgcagcatttttcaggcaagcataaatctccaaatcttcagattttgaatcagctagaacaaaatctcagcattgctttttatgctattagtcattctcaattggttattttccttttgttccagtcattctaaatggcaaaaaacaacaaaaacaaaaaagcaatcatgaagtcacatccttggatgttattagtagaaaataaaacggcattcacttctattctgttgaacatatacttactctgaacaaaagaaattgatgaactaaaacaaacaaaatatgttcctcagccctgctttagacagataagcaagacaattaatatcaaggctgttatttctttgttccaattttctatgcctgttcctaatttatattctccaaggtatctgagattagataactattaaagtttcattctgtattatttttggtatttagtgaaagtttattacctacaggccttttgagataaataaactttaatgtattactatccctacagaatgtcagacctggaaagaaccataaggatgagatttttctgggacaaccatctcattttgcacatgagaaaacaggcccagagcaccctgagatgtgtgtgctttgggagttcagagtggaccctctttgtaacacaatactttctgtacacgtagtcctttgtttgaaattctttttaaattgtgtatgctgagtaagaagttacatttgagcttttttaaaaatcaattttttccactagtgtagtaaaggaacactactattatcagattcggcttatttgttcaagcacccactgggacattgaggaaggacaggaagtatagtggaggagtttgactaaatataattgaggaataatcctctttccccagtacaaaggagcttttcagaggcttattgctgtcctacctggttggttgtaatttgctgagcatgtaatttctgtgttaagagctgttcacaagacaaagggcacagatggcttttgggagccttgttaattgttgataattcttcttcactctagtccccacccagaagccagaaaaatatgctaccaggtatgctagctgttcaagcttaaaactattttttaatagaaactttattaggaaaaataatccagtaagttccatatactccttccgtgcttggttcccaccgtcttcctccccgttacttaccaacaatcctggtcccagtgtcttcccttccagtgtggtgtcttttcctgctgctggccttatgtcctgacacaaatgctgaaagttacttcctccagtgtccttccaagtatctgaacagtacagtgactctgtctttacctgcttcaattgaagagtgagaagcttctggtggctgtgtgatcgtcagcttcattaatcagtaggtcacagtctaaacatttctcctcaccggtgccatgactcttggtgaccagattgaaaatctgatgaggcccagagagcaaaagtgactctaccagtgactggaccccactcatggcaggccaggattaaggtgggaatctcctgtcccatctctcaggtgaatgtcacactgtttgagacaacttaaggaagggatatagagagagtgagtgtgccccatggtagctttaatctggcaaagcagaacaacacgaatggagcaaaagtctcaaagcaaaatctctcactcaaaagacagtgtgccttactaattaagaacaaaggatttggagttatggaggcctatacctgagtcccagatgtgctgcttacctactgtctgacttggaaacattgtttaaccccactgaaccttaattttctaccctgtggatgaaatctatgatacctacaccatgaggttgtcttgaagaactagatgacataatttataaaaaagacttagatgaatatctaatatgtgcaggccaagatggtaactattactatcaagatgagccctgctgcattctcacccttatttactctttttaattttctggaaatcttgctatttcagtcatctttttgagatgcttatcaaggattggctcttaagagcacatggctttgtatcagatacagctatgtttgagtttggactacaacatttatttactatttatgttactctatgcaggtcagtctacctttacaaagctcagtttttggacttgtaaaataggaataatacgcatacatcttgatagagatgggcctagttaaaagattaagttagattaaatgagactataaattttaataaaaacaagaaccctatcttatacaacgtggtgttccttgcatctggcaatgtgccttgcatataattagtgctcaataaatagttgttaaaggaaacaattaataatgcatgaatacagcttttaatacagtgtcttacacatattaagtgggaactatatctgtcatacaccagttaaaatatatgcggagaaacagaattgcagggccatttaatatttctctcagtagatacccatctggaatagcctctcagactaccaagatgtctctgtaaatgactctgactacttttttcttaataaataaatgccagggagacaaatttcagagaaggtggaggcagaaggggttaacagctgattctgggctctcttgtagagacctccagactggcagaataagttctgacatttgggaatgctaggtgggtaggtgggaagggatgatactgaaggttgggagcttgcatgaaacaggtgactacgaggaaggtaaaagggttgagattatgaatacctggccttaaatcctgccttgaaacctggaaaaatcacatagttttgctctcaactgccccatttataaaacaggaataacagtatttgcaggattatcgtgagaattaaatgagagagtggatataaaagtgatttgtaaaatactgaaccaaaataaggagtcatccctccaggatggaactttgcttactccatgattctattcaactcgaaatcctgactgagtccaagttgaccaaacctaattaggtttccatcttatatcatgaatgttctctggattttatgggaaaaaatagaattcatatcaatacagtaaatattgattttatatgttttgaacaaagtactttttaaattatctgaaaccctccctgaccaccctggcagtcagttattcatacatctggcaaccacatcaccttgaacttctctttcctcttgattacatttgttatttgtcctctcttatagaacttgagctggaattctagtgctttaagaaactctcattaaatgactgttgaaagaacaaataaatattttgaactgagaatgaaatatgttgccaattatttggtagacaacatacagcataagtcaagtgtgtattacatataaagcatccctagtctaaaaatttgaaatccatactgcaccaaaattcaaaactctttgatggcaacatgatgtcacaagtggataatttcacacctaaccttatgtgatgagttacagtcaaaacacagtcagaaccttgtttcatacacaaaattattaaaaatattatataaaattaccttcaggctgtctgtataaggtgtatttgaaacattaatgaatcctatgtttagatttgggtctcatttcaaagatatctcacttatgtataggtaaatatttcaaagtccaaaaagatctgaaatccaagatacttatggttctatgcatttctaataagggatactcaacctgaatatatataaagagcacagacaaaatgctctattatagtccaaaatgtgtcagccacaatgaaaccccaaagagctaatctcactggcactgtggcacccacaaagctataaattttgattattttcctagagttgacaattgcctaattgttttactcctttggtattttgatctcctttattaatttttcccaagcacttcaacagaatcatcgaaatctctcagtactatttatcatattggtaaactcaccgcataactccttctggaatcctctatcatcatgttacaatcttaagtggtttctgtctatgcctttcacacagcttctatgcaggataagtggaagatttaccctgaaacttctctccagaatcctcctgaggattatctgtccctttctttttatatctcttgtttatagatgggatattttcctttgtgccagcttatgttttccttcatgagaagcatatcttctaataacatattgagaaagagagatgaaggaatgacacttctgagactgcttgaatagcagtgcctctattatatgcttatgcttgattttttaggaggtgaggtatagaaccatagataagaaattattttcccttagaatcttatagtattgttccatttctgtcaagctttggcattaatattgagcatttaaaattacctaatttcagtttcagtgctgatttttctctctggaaggttgtacatatttccttaatatttgatgttcaaaattttcatgatgatatgtcttggcctgggtttttgtttttgtatttttattgttttgcatttttgttagagaccacgtttgtttactcagcaactgttatttccgccgggcacagtggttcacgcctgtaatcccagcactttgggaggccgaggcgggcggatcacgaggtcaagagtttcagaccatcctggccaacatggtgaaaccccgtctctactaaaaatacaaaaattagccgggcgtggtggcaggtgcctgtagtcccagctacttgggaggctgaggctggagaatggcgtgaatccgcgaggcggagcttgcagtgagccgagatggcgccactgcactccagcctgggcgacagagcgagactccatctcaaaagaaaaaagaaaagaaactgttatatcattccttgacaatttccttcccaataatctctctgttttctttctggagagtatattagtcagatttcatagattgaacctcaaattcagtatttttcaaactttatcatgcattagaatcacctggaggcttcttcatacagattgctggcttcacttccagtaactgattaagttgggatgatggttgagaatttccttttctaacaagtgtatggcttactgctgctagatatcctttgagaaccactgttctaattctcttcttctggtaacttttgtttttcacatcattttcttttttgttcccctctcggaattaataccgactcattattgtctcgatttttggtcagattttaattttagctataatatatttaattttctaaagctcttttgtgttttatggttaagggtataatattttaaaaaatagaagtataatttacatacagtaaatatagatatcaaatgtataatttcatgagatctgacgattatgtacatatctaaccaacatcctgatcacaacatagaattttttctttcttctgaaagtttccatgcccactgccagtcattcttcctgcccacatgtcacaactctcctgatttacataaccatagatttgtttgtatgtgaattttatatacatggaaacatacgttatgatctcttgtgtctgacttctttactcaacgtatttttgaggttcatccatattgtttcatttacagtggttcattcctttgtattgctgagtagtattccattatttaaataatatacaacttatctatttttccagttgatacatttgagatcttacccctacccctagtttttggctattgtaaatagggcttttataagcaatattgtacatatatgttgtggacatatgtttttatttctccttagagtagaatttcaggcttgttgggttaggagtatattcaaacttaaaagaaactgccaaagagtttcctaaaatagttgtatcaccttatgctttcaccagcaatctataggaattcttgttgttatgtatctgacacttgatgttttcgttatttttatttttagcatttctagttattgtgaagtggtattgcattgttattctaatttgcatttggctaataatttataatttaagattttctcatgtaatttttgatcatttaaatatcttgtttgatgaagtatctgtcaaaacttgtggcaacttattattgatttgcagaaattatttagctatttaggatacaaattatctttcaaatataagtattatatgtactttttctcagactatgaattcttttgttaacagtgtttttcatgaaagttttaaattatgacagaatgagaaaaattaattcttaagtgtattgctttttgtgtactaagaaatctttgcacccaaattgtagacattctcccaaatttttatctggatggtttataattttagtcctcatatttagttctatagtgtaattttatctttttatttataatttttatataattgtacatatttatgaggaacaacaggatgttttgatacatgtataaattgtgtaatcatcacatcagggtaattagcatatccatcacattaaacattatttctttgtgagaaatttattatttctttgtgagattcaaaaacctctcctttaggtattttgaaatatacaatacatcagactatgcaatagactgacagaacttatttttcgtatctaattgtagctttgtacccatnnnnnnnnnnnnnnnnnnnnattctactctctacttctgtgaggacaacttcttagattccacatattattgagatcatgtgatatttgtctttctgtgactgggttgtttaacttaacataatgttattcaggtttatccatgttgctacaaatgacaggatttcattttttatggctgaatagtattccactgtgtgtctatatgtgtatatatatatattatatatacatatatataatgtgtatatatattatatacatatatataatgtgtatatatataatgtattctttatccattaatctgttgatggatatttaggttgattacatatcttggctattgtgaatattgcagcaataaacatggatgtgcaaatatctcttcaacatactgatttcattttctttgaatatatacccaaatgtaatgagatttctggatcatatggtggttccatttttaattttttgaagaaactccatactgtttttcataatggctatgctaatttacattttcaccatcagcgtgtaaggattcccttttcaccacattgttgctaacacttgtcatctttcgattttttaaaaattgtcattctgactggagtcaggtgatattgtagttttgatttgcatttccctggagattaataaagtcaagcattttttttttatttctgttggtcatctgtatgtcttctctggaaaaatgtctattcaggtcctttgcacattttttgttgaatgttttgttgttgagctgtttgagttttttatatattttagatgttagcctcttatcagatgtatagtttgcaaatatattcttctattctgtcagttgtccctaaaacagcatggctctgtcatagaaacagaaacatagaccaatggaacagaatataaaactggaattaaacccaagcatctatagacaactgatatacaacaaagatgtcaagtacatgcaatggggaaaggacagtttcctcaataaacaatgctgggaaaactggatattcacatacagaagaacaaaactagacccttatctctcaccatatacagaaattaactactaaaaatgtattaaagaattaaacgtaagaccccaaactacaaaactacttgtaaaaaacagggaaaagctccaagacattgctctaggcaaggattttaaaaataaaaccacaaaagcatgggcaagaaaagcaaatacagacaaatggtatcatatgaaattaaaaaaaaaaacttctgcacagcaaagacagcaatgaacagagcaaagagacaaccaacaaaataggtgaatatattcacaaattatgatgtaattttaattaataaaaaacaatttctatatgtagtttgacgtaggagtgaagctcattgctcatttatttttaaaatgggtttccagttgtaggatttttttttaatggtttttatttccttcattgaattgccttgtcacttctgttgaaaagctattgaccacatatatgtgactttatttctggagtctattctgtttctttccactaatctgtatgtctaccttgtaccaaattcccgctgtcttcattggctttatagtaatctacgtaatctggtagtgtgaattctctgagttaattcctattttccaagaacgttttgttattctgagtttttattttcttgattttccatagaagtgttatgagtaagttgttgatttctaccaaaaagaagcttattggatcttgtttaggattacattagattcatcaattgctttggggaaaatttacattttatgaaattatcccttccaattcatgaaaattgtacaaatccctctttatttaggtatactttaatttctctggaatattttgttttgtctgcaaagctcttgaacatttttgttcaatctaaccctgtaggtttagtatttttgatcatattcaaaataaaactttataaaatttatttttccaattgtttggtgcaggaatatagaaatgaaatagatttttatatattaacccttatcctgagacctgactaaatgcacttcctggttttagtagttttatttcctttgagtttacttgaaaatttttatgtgaataatcatgtcatatataaataaagataattttgtttctttgtgttcaagctctgtactttttacatatttttcttcttcttttatgcaatgactaactaggaacttcaaccatgttttctggaaggagtgagtaccgacaatgcttgccctgctcatagatggatagcgtttgatccttcaccattaagtgtgatataagtgtaatgtttcttgtaggtttttcatagttgtcctttatgatattgaggaactttccttatatttcaggttttctgatagtttttgatagaattggtactgaatttctaaaatgctttttttgtgtgtggtgatcctgttgctcttgattttgttattgtggtaaattacactgattgatttccaaaagttatatcaaacttgcattcgtaggacaaatctaacttgctcaaatgtatcataccttttacaaattgctgtaatcaatttgctgttttaataaagactttttaaatctgtattcacgaagaatgtatgtcttttcatctgtattcatgaaggatgtgtgtctatgaggcaattgttctataagtaatattttatcagtattttaatatctgctaaaacgaggtttcataaaattagtaaaggacctgattttctttcttttctgagaaggtatatatataccttctcccatatatatataaaatagaagagaaggtacatataccttttttatatatatatatacctatatgcatatacctttatatatag

SEQ ID NO: 4 - DNA, 30 bp, Artificial
  primer
gctccctgcagcatgggtgctgggccctcc

SEQ ID NO: 5 - DNA, 30 bp, Artificial
  primer
gcataccctacaatttaggaattggtgtgg

SEQ ID NO: 6 - DNA, 40 bp, Artificial
  probe
ggccagtgaattgtaatacgactcactatagggaggcggt

SEQ ID NO: 7 - DNA, 360 bp, Mus musculus
  misc_feature (157)..(157): n is a, c, g, or t
gctgttttgcttgtgggctatggaagagatccagttactgggatagaatactggattataaagaacagctggggctctaactggggggagagtggctacttccgtatccgcagaggaactgatgaatgtgcaattgagagtatagccgtggcggccnataccgattcctaaattataggacatagctcccagtgttacatacgggtctttatcactcacagagtgatttagtcacatgctgaagactttttcagagcaatatcagaagcttaccactaagcatctttaaagaattttgtctttgaacttaaaaccatccttgatttttttcttttaatatcttccccatcaactactgaa

The invention claimed is:

1. A method for identifying a compound that reduces pain comprising:

a. providing a test cell transfected with a nucleic acid vector comprising the promoter of a Cathepsin C gene operably linked to a reporter gene;

b. determining the reporter gene activity of the test cells in the presence of a test compound;

c. determining the reporter gene activity of the test cells in absence of the test compound; and d. comparing the reporter gene activity of the test cells in the presence of the test compound to the reporter gene activity of the test cells in the absence of the test compound, wherein a decrease in activity of the reporter gene in the test cell in the presence of the test compound as compared to the activity of the reporter gene in the test cell in the absence of the test compound indicates that the test compound will reduce pain.

2. The method of claim 1, wherein the reporter gene is selected from the group consisting of beta lactamase (LacZ), luciferase, green fluorescent protein (GFP), blue fluorescent protein (BFP), DsRed, HIS3, URA3, TRP1, LEU2, and beta galactosidase.

3. A method for identifying a compound that reduces pain comprising:
   a. contacting a nucleic acid coding for a Cathepsin C protein with a test compound in a transcriptionally active system;
   b. determining the amount of mRNA coding for the Cathepsin C protein that is present in the system in the presence of the test compound;
   c. determining the amount of mRNA coding for the Cathepsin C protein that is present in the system in the absence of the test compound; and
   d. comparing the amount of mRNA that is present in the system in the presence of the test compound to the amount of mRNA that is present in the system in the absence of the test compound, wherein decreased expression of mRNA in the presence of the test compound as compared to the expression level of mRNA in the absence of the test compound indicates that the test compound will reduce pain.

4. The method of claim 3, wherein a cell expressing recombinant Cathepsin C is used.

5. The method of claim 4, wherein Cathepsin C is encoded by a polynucleotide selected from the group consisting of:
   a. a polynucleotide comprising the nucleic acid sequence of SEQ ID NO: 1, and
   b. a polynucleotide coding for the Cathepsin C protein of SEQ ID NO: 2.

6. A method for identifying a compound that reduces pain comprising:
   a. providing a test cell transfected with a nucleic acid vector comprising the promoter of a Cathepsin C gene operably linked to a reporter gene;
   b. providing a control cell transfected with a control vector comprising a reporter gene that is not operably linked to the promoter of a Cathepsin C gene;
   c. determining the reporter gene activity of each of the cells in steps a) and b) in the presence of a test compound; and
   d. comparing the reporter gene activity of the test cell in the presence of the test compound to the reporter gene activity of the control cell in the presence of the test compound, wherein decreased activity of the reporter gene in the test cell in the presence of the test compound as compared to the activity of the reporter gene in the control cell in the presence of the test compound indicates that the test compound will reduce pain.

7. The method of claim 6, wherein the reporter gene is selected from the group consisting of beta lactamase (LacZ), luciferase, green fluorescent protein (GFP), blue fluorescent protein (BFP), DsRed, HIS3, URA3, TRP1, LEU2, and beta galactosidase.

* * * * *

UNITED STATES PATENT AND TRADEMARK OFFICE
CERTIFICATE OF CORRECTION

PATENT NO. : 8,349,567 B2
APPLICATION NO. : 12/934178
DATED : January 8, 2013
INVENTOR(S) : Mathias Gebauer et al.

It is certified that error appears in the above-identified patent and that said Letters Patent is hereby corrected as shown below:

On the Title page, in item (56), in column 2, under "Other Publications", line 16, delete "funtion" and insert -- function --, therefor.

On the Title page, in item (56), in column 2, under "Other Publications", line 18-19, delete "Mutationin Brief" and insert -- Mutation in Brief --, therefor.

On the Title page, in item (56), in column 2, under "Other Publications", line 44, delete "Jul. 1998," and insert -- Jul. 1999, --, therefor.

Title page 2, column 1, under "Other Publications", line 10, delete "Osetopetrosis" and insert -- Osteopetrosis --, therefor.

In the Specifications:

In column 2, line 24, delete "C)" and insert - - C). - -, therefor.

In column 2, line 54, delete "orq.)," and insert - - org.), - -, therefor.

In column 2, line 64, delete "adress:" and insert - - address: - -, therefor.

In column 2, line 64, delete "qov)." and insert - - gov). - -, therefor.

In column 3, line 3, delete "5"flanking" and insert - - 5' flanking - -, therefor.

In column 4, line 10, delete "N-glycosilation" and insert - - N-glucosylation - -, therefor.

In column 4, line 11, delete "og" and insert - - of - -, therefor.

Signed and Sealed this
Sixth Day of August, 2013

Teresa Stanek Rea
*Acting Director of the United States Patent and Trademark Office*

CERTIFICATE OF CORRECTION (continued)
U.S. Pat. No. 8,349,567 B2

In column 5, line 46, delete "phosphoorothioate" and insert -- phosphorothioate --, therefor.

In column 5, line 48, delete "plypeptide" and insert -- polypeptide --, therefor.

In column 5, line 51, delete "cell-permeant" and insert -- cell-permanent --, therefor.

In column 6, line 41, delete "procaryotic" and insert -- prokaryotic --, therefor.

In column 6, line 44, delete "punction" and insert -- function --, therefor.

In column 7, line 2, delete "Supplemtent" and insert -- Supplement --, therefor.

In column 7, line 3, delete "Inc.:" and insert -- Inc.; --, therefor.

In column 8, line 12, delete "procaryotic" and insert -- prokaryotic --, therefor.

In column 8, line 14-15, delete "punction" and insert -- function --, therefor.

In column 8, line 61, delete "procaryotic" and insert -- prokaryotic --, therefor.

In column 8, line 64, delete "punction" and insert -- function --, therefor.

In column 10, line 9, delete "entitiy" and insert -- entity --, therefor.

In column 11, line 67, delete "procaryotic" and insert -- prokaryotic --, therefor.

In column 12, line 2, delete "punction" and insert -- function --, therefor.

In column 14, line 67, delete "(US)," and insert -- (TTS), --, therefor.

In column 15, line 67, delete "1999)" and insert -- 1999). --, therefor.

In column 16, line 52, delete "Committee" and insert -- Committee. --, therefor.

In column 16, line 55, delete "nerve-transsected" and insert -- nerve-transected --, therefor.

In column 18, line 6, delete "pf" and insert -- of --, therefor.

In column 19, line 36, delete "uptdated;" and insert -- updated; --, therefor.

In column 20, line 6, delete "Handboook." and insert -- Handbook. --, therefor.

In column 20, line 31, delete "uptdated," and insert -- updated, --, therefor.